United States Patent 12,570,711 (PLATFORMS FOR CO-STIMULATION, NOVEL CAR DESIGNS AND OTHER ENHANCEMENTS FOR ADOPTIVE CELLULAR THERAPY) - sequence listing, part 4

SEQ ID NO: 3497 - DNA, 3393 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacctgtagagccagccagagcatcggcaccagcctgcactggtatcagcagaagcctggcaaggcccccaagctgctgattaagttcgccagcagactgcagagcggcgtgcccagcagattttctggcagcggctccggcaccgacttcaccctgacaatcagctccctgcagcccgaggacttcgccacctactactgccagcagagccccggcttccctccaacctttggacagggcaccaagctggaaatcaagcggctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggtggaatctggcggcggacttgtgaagccaggcggcagcctgagactgagctgtgccgccagcggcttcagcatcaccaccagcggctactactggacctggatcagacagttccccggcaagggcctggaatggatgggctacatcggctacaacagcaagacctactacaaccccgccctgaagtcccggatcaccatcagcagagacaacgccaagaacagcctgtacctgcagatgaactccctgagagccgaggataccgccgtgtactactgcgccagatccctgtacggcggctacaaggacgccttcgatagctggggccagggaacccttgtgaccgtgtctagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3498 - DNA, 3408 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacccagagccctctgagcctgcctgtgacacctggcgagcctgccagcatctcctgtagaagcagccagagcctgctgcacagcatcggctacaactacctggactggtatctccagaagcccggccagagcccccaactgctgatctacctgggcagcaacagagccagcggcgtgcccgatagattttccggcagcggctccggcaccgacttcaccctgaagatcagccgggtggaagccgaggacgtgggcgtgtactactgtatgcaggccctccagacccccctgacctttggcggaggcaccaaggtggaaatcaagcggctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactggtggaaagcggaggcggcgtggtgcagcctggaagaagcctgagactgagctgtgccgccagcggcttcaccttccggtcctacggaatgcactgggtgcgccaggcccctggcaaaggactggaatgggtggccgtgatctcctacgacggctccaacaagtactacaccgacagcgtgaacggcagattcaccatcagcagagacaacagcaagaacaccctgtacctccagatgaacagcctgcgggccgaggacaccgccgtgtactattgtgctagaggcggaggctactacgagacaagcggccctgattactggggccagggcacactcgtgaccgtgtctagtacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3499 - DNA, 3402 bp, Artificial Sequence
  Synthetic Polynucleotide encoding a CAR with optional accessory module(s)
atggccttaccagtgaccgccttgctcctgccgctggccttgctgctccacgccgccaggccggacgacgtcgtgatgacccagagccctctgagcctgcctgtgacacctggcgagcctgccagcatctcctgtagaagcagccagagcctgctgcacagcatcggctacaactacctgcactggtttctccagaagcccggccagagcccccaactgctgatctacctgggcagcaacagagccagcggcgtgcccgatagattttccggcagcggctccggcaccgacttcaccctgaagatcagccgggtggaagccgaggacgtgggcgtgtactactgtatgcaggccctccagacccctcccacctttggacagggcaccagactggaaatcaagcggctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaactccaactccaggaaagcggccctggcctcgtgaagcctagcggcacactgagcctgacatgtgccgtgtctggcggcagcatcagcagcagcaactggtggtcttgggtgcgccagcctcctggcaagggcctggaatggatcggcgaaatctaccacagcggcagcaccaactacaaccccagcctgaagtccagagtgaccatcagcgtggacaagagcaagaaccagttctccctgaagctgagcagcgtgacagccgccgataccgccgtgtactattgcgtgggcagcccctacggcgactacgtgctggattattggggccagggcaccctcgtgaccgtgtctagtacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3500 - DNA, 3408 bp, Artificial Sequence; identical to SEQ ID NO: 3498
  Synthetic Polynucleotide encoding a CAR with optional accessory module(s)

SEQ ID NO: 3501 - DNA, 3396 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacacagagccctggcaccctgagcctgtctctgggagagagagccacactgagctgtcgggccagccagtctatcagcagcagcttcctggcctggtatcagcagaagcccggccaggcccctaagctgctgatctacgccgccagcacaagagccaccggcatccccgatagattcagcggctctggcagcggcaccgacttcaccctgaccatcagcagactggaacccgaggacttcgccgtgtactactgccagcagtacggcagaagcctgagcttcggcggaggcaccaaggtggaagtgaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactccagcagtctggccccggactcgtgaagcctagccagacactgagcctgacctgcgccatcagcggcgatagcgtgtccggcaatagcgccacctggaactggatcagacagagcccatctcggggcctggaatggctgggccggacctactaccgcagcaagtggaaccacgactacgccgagagcgtgaagtcccggatcaccatcaaccccgacaccagcaagaaccagttctccttgcaactgaacagcgtgacccccgaggacacagccgtgtattattgcgccagaggcgacagcagctcttggtacgccttcgactattggggccagggcaccctcgtgaccgtgtctagtacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3502 - DNA, 3396 bp, Artificial Sequence
  Synthetic Polynucleotide encoding a CAR with optional accessory module(s)
atggccttaccagtgaccgccttgctcctgccgctggccttgctgctccacgccgccaggccggaccagaccgtcgtgacacagcctcctagcgcctctggcacaccaggccagagagtgaccatctcctgtagcggcagcagcagcaacatcggcagcaactacgtgtactggtatcagcaactgcccggcaccgcccccaagctgctgatctacagaagcaaccagcggcccagcggcgtgcccgatagattttctggcagcaagagcggcaccagcgccagcctggctatctctggacctagaagcgtggacgaggccgactactactgcgccgcctgggacgatagcctgaacggcgtggtgtttggcggaggcaccaagctgacagtgctgggtctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggtgcagtctggggccgaagtgaagaaacccggcagctccgtgaaggtgtcctgcaaggcttccggcggcaccttcagcagctacgccatttcttgggtgcgccaggcccctggacagggcctggaatggatgggcggcatcatccccatctttggcaccgccaactacgcccagaaattccagggccgcgtgaccatcaccgccgacgagtctacaagcaccgcctacatggaactgagcagcctgcggagcgaggataccgccgtgtactactgtgccagaagaatccccccctactacggcatggacgtgtggggccagggaaccaccgtgaccgtgtcatctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3503 - DNA, 3393 bp, Artificial Sequence
  Synthetic Polynucleotide encoding a CAR with optional accessory module(s)
atggccttaccagtgaccgccttgctcctgccgctggccttgctgctccacgccgccaggccggaccagagcgtcgtgacacagcctcctagcgtgtcagtggcccctggcaagaccgccagaatcacctgtggccggaacaacatcggcagcaagagcgtgcactggtatcagcagaagcccggccaggctcctgtgctggtggtgtacgacgacagcgacagacccagcggcatccccgagagattcagcggcagcaactccggcaataccgccaccctgaccatcagcagagtggaagccggcgacgaggccgactactactgccaagtgtgggacagcagcagcgatcacgtggtgtttggcggaggcaccaagctgacagtgctgggtctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgcaactggtgcagtctggcggaggggtcatgcggcctggcggatctctgagactgtcttgtgccgccagcggcttcaccttcgacgactacggcatgagctgggtgcgccaggcccctggaaaaggcctggaatgggtgtccggcatcaactggaatggcggcagcaccggctacgccgattctgtgcggggcagattcaccatcagccgggacaacgccaagaacagcctgtacctgcagatgaactccctgcgggccgaggacaccgccctgtactattgcgccagagagcggggctacggctaccacgaccctcacgattattggggccagggcacccttgttaccgtgtcctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3504 - DNA, 3432 bp, Artificial Sequence
  Synthetic Polynucleotide encoding a CAR with optional accessory module(s)
atggccttaccagtgaccgccttgctcctgccgctggccttgctgctccacgccgccaggccggaacagaaactcatcagtgaagaagacctggaattccaggctgtcgtgacacagcctcctagcgcctctggcacaccaggccagagagtgaccatctcctgtagcggcagcagcagcaacatcggcagcaacaccgtgaactggtatcagcaggtgcccggcaccgctcccaagctgctgatctacagcaacaaccagcggcccagcggcgtgcccgatagattttctggcagcaagagcggcaccagcgccagcctggctatctctggactccagtccgaggacgaggccgactactattgcgccgcctgggacgatagcctgaacggctgggtgttcggcggaggcaccaagctgacagtgctgctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacagatgcaactggtgcagagcggagccgaagtgaaagagcctggcgagagcctgcggatctcctgcaagggcagcggctacagcttcaccaatttctggatctcttgggtgcgccagatgcccggcaagggcctggaatggatgggcagagtggaccccggctactcctacagcacctacagccctagcttccagggccacgtgaccatcagcgccgacaagagcaccagcaccgcctacctccagtggaacagcctgaaggccagcgacaccgccatgtactactgcgccagagtgcagtacagcggctattacgattggttcgacccctggggccagggcacactcgtgacagtgtcaagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3505 - DNA, 3414 bp, Artificial Sequence
  Synthetic Polynucleotide encoding a CAR with optional accessory module(s)
atggccttaccagtgaccgccttgctcctgccgctggccttgctgctccacgccgccaggccggaacagaaactcatcagtgaagaagacctggaattcgacatccagatgacccagagccccagcacactgagcgccagcgtgggcgacagagtgaccatcacctgtcgggccagccagaacatcaacaagtggctggcctggtatcagcagaggcccggaaaagccccccagctgctgatctacaaggccagcagcctggaaagcggcgtgcccagcagattttctggcagcggctctggcaccgagtacaccctgaccatcagctccctccagcccgacgacttcgccacctactactgccagcagtacaacagctacgccaccttcggccagggcaccaaggtggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcagctggtgcagtctggggccgaagtgaagaagcctggcgagagcctgaagatcagctgcaagggctccggctacaacttctctaacaagtggatcggctgggtgcgccagctgcctggcagaggactggaatggatcgccatcatctaccccggctacagcgacatcacctacagccccagcttccagggccgcgtgacaatcagcgccgacaccagcatcaacaccgcctacctgcactggcacagcctgaaggccagcgacaccgccatgtactactgcgtgcggcatacagccctggctggcttcgattattggggcctgggcaccctcgtgaccgtgtctagtacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3506 - DNA, 3390 bp, Artificial Sequence
  Synthetic Polynucleotide encoding a CAR with optional accessory module(s)
atggccttaccagtgaccgccttgctcctgccgctggccttgctgctccacgccgccaggccggacatcgtgctgacacagagccctgcttctctggccgtgtctctgggacagagagccaccatcagctgtagagccagcgagagcgtggacaactacggcaacaccttcatgcactggtatcagcagaagcccggccagcctcctaagctgctgatctacagagccagcaacctggaaagcggcatccccgccagattttctggcagcggcagcagaaccgacttcaccctgaccatcaatcccgtggaagccgacgacgtggcaacctactactgccagcagagcaacgaggaccctcctacatttggagccggcaccaagctggaactgaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacagattcagctggtgcagtctggccccgagctgaagaaacctggcgagacagtgaagatcagctgcaaggccagcggctacatcttcaccaattacggcatgaactgggtcaagcaggcccctggcaagagcttcaagtggatgggctggatcaacacctacaccggcgagagcacatacagcgccgacttcaagggcagattcgccttcagcctggaaaccagcgccagcacagcctacctgcacatcaacgacctgaagaacgaggacaccgccacctacttttgcgccagaagcggcggctacgaccctatggattattggggccagggcaccagcgtgaccgtttcttctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3507 - DNA, 3387 bp, Artificial Sequence
  Synthetic Polynucleotide encoding a CAR with optional accessory module(s)
atggccttaccagtgaccgccttgctcctgccgctggccttgctgctccacgccgccaggccggacgagatcgtgctgacacagagccctggcaccctgagcctgtctccaggcgaaagagccacactgagctgtcgggccagccagagcgtgtccaatacctacctggcctggtatcaccagaggcccggacaggctccccggctgctgatctatggcgcttctagcagagccaccggcatccccgatagattcagcggctctggcagcggcaccgacttcgccctgacaatcagctccctggaacccgaggacttcgccgtgtactactgccagcagtacagcaactcctggaccttcggccagggcaccaaggtggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggtggaatctggcgggggagtggtgcagcctggcagaagcctgagactgtcttgtgccgccagcggcttcaccttcagcagctacgacatgcactgggtgcgccaggcccctggcaaaggactggaatgggtggccgtgatctcctacgacggcaccaacgagtattacgccgacagcgtgaagggccggttcaccatctccagagacaccagcaagaacaccctgtacctccagatgaacagcctgcgggccgaggacacagccgtgtattattgcgccagagagcggtacttcgactggtccttcgactactggggccagggaaccctggtgtccgtgtctagtacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3508 - DNA, 3384 bp, Artificial Sequence
  Synthetic Polynucleotide encoding a CAR with optional accessory module(s)
atggccttaccagtgaccgccttgctcctgccgctggccttgctgctccacgccgccaggccggacgagctgacacaggaccctgctgtgtctgttgccctgggccagacagtgcggattacctgtcaaggcgacagcctgagaagcaactacgccaactggtatcagcagaagcccggacaggctcccgtgctggttatctacggccagaacaacagacccagcggcatccccgatagattcagcggctctagctctggcaataccgccagcctgacaatcactggcgctcaggctgccgatgaggccgactactactgcgatagcagagtgtccaccggcaatcacgtggtgtttggcggcggaacaaagctgacagtgctcggacaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctggtgcagagcggagccgaagtgaagaaacctggggcctctgtgaaggtgtcctgcaaggcttccggctacacctttaccagctacgccatgcactgggtccgacaggcacctggacaacggcttgaatggatgggctggatcaacgccggcaacggcaacaccaagtacagccagaaattccagggccgcgtgaccatcaccagagatacaagcgccagcaccgcctacatggaactgtctagcctgagatccgaggacaccgccgtgtactactgtgccagagacatcagctacggcagcttcgactattggggccagggcacactggtcaccgttagctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3509 - DNA, 3390 bp, Artificial Sequence
  Synthetic Polynucleotide encoding a CAR with optional accessory module(s)
atggccttaccagtgaccgccttgctcctgccgctggccttgctgctccacgccgccaggccggacgacatcgtgctgacacagacaccagccacactgagcgtgacacctggcgattctgtgtccctgagctgtagagccagccagagcatcagcaacaacctgcactggtatcagcagaagtcccacgagagccccagactgctgattaagaacgccagccagtctatcagcggcatccccagcaagtttagcggctctggcagcggcaccgacttcaccctgagaatcaacagcgtggaaaccgaggacttcgggatgtacttctgccagcagagcaatagctggccctacacatttggctccggcaccaagctggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgaagctgcaacagagcggacccgagctggttaagccaggcgcttccgtgaagattagctgcaaggccagcggctacagcttcaccggctactacatgcactgggtcaagcagagccacggcaacatcctggactggatcggctacatctacccctacaacggcgtgtccagctacaaccagaagttcaagggcaaagccactctgaccgtggacaagagcagcagcaccgcctacatggaactgagaagcctgaccagcgaggacagcgccgtgtactattgtgccagagagcggggcctgtaccagctcagagcaatggattattggggccagggcaccagcgtgaccgtttcttctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3510 - DNA, 3363 bp, Artificial Sequence
  Synthetic Polynucleotide encoding a CAR with optional accessory module(s)
atggccttaccagtgaccgccttgctcctgccgctggccttgctgctccacgccgccaggccggacgacatcgtgatgacacagacccctgccatcatgagcgcctctccaggccagaaagtgaccatcacatgtagcgccagcagcagcgtgaactacatgcactggtatcagcagaagctgggcagcagccccaagctgtggatctacgataccagcaaactggcccctggcgtgccagccagattttctggttctggcagcggcaccagctacagcctgacaatcagcagcatggaagccgaggatgccgccagctacttctgccatcagtggtctagctacccctacacctttggctccggcaccaagctggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctccaagagtctggccccgacctggtcaagcctagccaaagcctgagcctgacctgtaccgtgaccggctacagcatcacaagcggctatggatggcactggatcagacagttccccggcaacaaactggaatggatgggctacatccactacagcggcagcaccacctacaatcccagcctgaagtcccggatcagcatcagcagagacaccagcaagaaccagttcttcctgcaactgaacagcgtgaccaccgaggacaccgccacctactattgtgctcggagcctgagatattggggccagggcacaaccctgaccgtgtcatctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3511 - DNA, 3372 bp, Artificial Sequence
  Synthetic Polynucleotide encoding a CAR with optional accessory module(s)
atggccttaccagtgaccgccttgctcctgccgctggccttgctgctccacgccgccaggccggacgacatccagatgacacagagccctagcagcctgtctgccagcgtgggagacagagtgaccatcacctgtagcgccaccagcagcatcagctacatgcactggtatcagcagaagcccggcaaggcccctaaaggctggatctacgataccagcaaactggcccacggcgtgcccagcagattttctggttctggcagcggcaccgacttcaccctgacaatatctagcctccagcctgaggacttcgccacctactactgccaccagagaagaagctaccccttcaccttcggccagggcaccaaggtggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactggttcagagcggagccgaagtgaagaaacctggggcctctgtgaaggtgtcctgcaaggcttccggctacacctttaccaatttctggattcactgggtccgacaggctccaggccaaggactggaatggatcggagagatcgaccccagcgacagctacaccaactacaaccagaaattcaaaggccgggtcaccatcaccagagacaccagcacaagcaccgcctacctggaactgagcagcctgagaagcgaggacaccgccgtgtactactgcgccagggaaatcaccaccgtggattattggggccagggaaccctggtcaccgtgtcatctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3512 - DNA, 3393 bp, Artificial Sequence
  Synthetic Polynucleotide encoding a CAR with optional accessory module(s)
atggccttaccagtgaccgccttgctcctgccgctggccttgctgctccacgccgccaggccggacgacatccagatgacacagagccctagcagcctgtctgccagcgtgggagacagagtgaccatcacatgcaaggccagccagggcttcaacaaatacgtggcctggtatcagcagaagcccggcaaggctcctaagctgctgatctactacaccagcacactccagcctggcgtgcccagcagattttctggctctggcagcggcagagactacaccctgacaatatccagcctccagccagaggacttcgccacctactactgtctccagtacggcaacctgctgtacgcctttggacagggcaccaaggtggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagcttgtgcagagcggagccgaagtgaagaaacctggggcctctgtgaaggtgtcctgcaaagccagcggctacacctttaccagctactggatcggctgggtccgacaggctcctggacaaggactggaatggatcggcgacatctatcccggcggaggctacaccaactacaacgagaagttcaagggccgcgtgacaatcaccagagacacctctacaagcaccgcctacctggaactgagcagcctgagaagcgaggacaccgccgtgtactactgcgccagactggatggcagcagctacagaggcgctatggattcttggggccagggcacactggtcaccgtttcttctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3513 - DNA, 3405 bp, Artificial Sequence
  Synthetic Polynucleotide encoding a CAR with optional accessory module(s)
atggccttaccagtgaccgccttgctcctgccgctggccttgctgctccacgccgccaggccggacgacatccagctcacacagagcccttctagcctgtctgccagcgtgggcgacagagtgaccatcacatgtagagccagccagagcgtggactacgacggcgacagctacatgaactggtatcagcagaagcccggcaaggcccctaagctgctgatctacgccgccagctatctggaaagcggcgtgccaagcagattttccggctctggcagcggcaccgatttcaccctgacaatatccagcctccagcctgaggacttcgccacctactactgccagcagagccatgaggacccctacacctttggacagggcaccaaggtggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcaactggttgaatctggcggcggactggttcagcctggcggatctctgagactgagctgtgccgtgtctggctacagcatcaccagcggctactcttggaactggatcagacaggcccctggcaaaggactggaatgggtcgcctccatcacctacgatggcagcaccaactacaaccccagcgtgaagggcagaatcaccatcagcagggacgacagcaagaacaccttctacctgcaaatgaacagcctgagagccgaggacaccgccgtgtactattgtgccagaggcagccactacttcggccactggcattttgctgtgtggggccagggaaccctggtcacagtttcttctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3514 - DNA, 3381 bp, Artificial Sequence
  Synthetic Polynucleotide encoding a CAR with optional accessory module(s)
atggccttaccagtgaccgccttgctcctgccgctggccttgctgctccacgccgccaggccggacgacatccagatgacacagagccctagcagcctgtctgccagcgtgggagacagagtgaccatcacctgtagagccagccaggacatccggtactacctgaactggtatcagcagaagcccggcaaggcccctaagctgctgatctatgtggcctccagcctccagagcggagtgccttctagattttctggcagcggctccggcaccgagtttaccctgacagtgtctagcttgcagcccgaggacttcgccacctactactgcctgcaagtgtacagcacccctcggacctttggacagggcaccaaggtggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagcttgttgaatctggcggcggactggctaagcctggcggatctctgagactgtcttgtgccgccagcggcttccggttcaccttcaacaactactacatggactgggtccgacaggcccctggacaaggacttgaatgggtgtccagaatcagcagcagcggcgaccctacttggtacgccgattctgtgaagggcagattcaccatcagcagagagaacgccaagaacaccctgttcctccagatgaactccctgagagccgaggacaccgccgtgtactattgtgcctctctgaccaccggcagcgattcttggggacagggcgtgctggttaccgtgtcatctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3515 - DNA, 3381 bp, Artificial Sequence
  Synthetic Polynucleotide encoding a CAR with optional accessory module(s)
atggccttaccagtgaccgccttgctcctgccgctggccttgctgctccacgccgccaggccggagatcgtgatgacacagagccccgccacactgagtgtgtctccaggcgaaagagccacactgtcctgtagagccagccagagcgtgtccagaaacctggcctggtatcagcagaagcctggacaggctccccggctgttgatctacggcgcttctacaagagccaccggcattcccgccagattttctggctctggcagcggcaccgagttcaccctgacaatcggaagcctccagagcgaggacttcgccgtgtactactgccagcagtacaagacctggcctcggacctttggacagggcaccaacgtggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctgcaacaatggggagccggcctgctgaagcctagcgaaacactgtctctgacctgcgccgtgttcggcggctctttcagcggctactactggtcctggatcagacagcctcctggcaaaggactggaatggatcggcgagatcaaccaccggggcaacaccaacgacaaccccagcctgaaaagcagagtgaccatcagcgtggacaccagcaagaaccagttcgccctgaagctgagcagcgtgacagccgctgataccgccgtgtattattgcgccagagagcggggctacacctacggcaatttcgatcactggggccagggcaccctggtcacagtttcttctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3516 - DNA, 3384 bp, Artificial Sequence
  Synthetic Polynucleotide encoding a CAR with optional accessory module(s)
atggccttaccagtgaccgccttgctcctgccgctggccttgctgctccacgccgccaggccggagatcgtgatgacccctagcagcgccacactgagtgtgtctccaggcgaaagagccacactgtcctgtagagccagccagagcgtgtccagaaacctggcctggtatcagcagaagcctggacaggctccccggctgttgatctacggcgcttctacaagagccaccggcattcccgccagattttctggctctggcagcggcaccgagttcaccctgacaatctctagcctccagagcgaggacttcgccgtgtactactgccaccagtacagcaactggatgtgcagcttcggccagggcaccaagctggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctccttgagtcaggtggcggcctggttcaacctggcggatctctgagactgagctgtgccgccagcggcttcacctttagcagatacgccatgaactgggtccgacaggcccctggcaaaggactggaatgggtgtccggcatctctggaagcggcggcagaacctactacgccgattctgtgaagggcagattcaccatcagccgggacaacagcaagaacaccctgtacctccagatgaacagcctgagagccgaggacacagccgtgtattattgcgccaaggaccgggacttttggagcggcccttttgactattggggccagggaaccctggtcaccgttagctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3517 - DNA, 3399 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacccagagccccagcagcctgtctgccagcgtgggcgacagagtgaccatcacatgcaaggccagcaagaacatcagaagctacctggcctggtatcagcagaagcccggcaaggcccccaagctgctgatctacagcggcagcacactgcacagcggcgtgcccagcagattttccggctctggcagcggcaccgacttcaccctgaccatctctagcctccagcccgaggacttcgccacctactactgccagcagcaccacgagtaccccctgacattcggccagggcaccaaggtggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactccaggaatctggccccggactcgtgaagcccagcgagacactgagcctgacctgtaccgtgtccggctacaccatcaccagcggctacgactggtcctggatcagacagcctcctggcaagggcctggaatggatcggctacatcaactacggcggctccaccaactacaagcccagcctgggaagccgcgtgacaatcagcgtggacacctccaagaaccagttcagcctgaagctgagcagcgtgacagccgccgataccgccgtgtactactgcgcccggtacaacgagtacaagagctacatctacgattggtacttcgacttctggggccagggaaccctcgtgaccgtgtctagtacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3518 - DNA, 3468 bp, Artificial Sequence
  Synthetic Polynucleotide encoding a CAR with optional accessory module(s)
atggccttaccagtgaccgccttgctcctgccgctggccttgctgctccacgccgccaggccggaactggttatgacacagagccccagcagcctgacagtgacagccggcgagaaagtgaccatgatctgcaagtctagccagagcctgctgaactccggcgatcagaagaactacctgacctggtatcagcagaaacccggccagcctcctaagctgctgatcttctgggccagcaccagagaaagcggcgtgcccgatagattcacaggcagcggcagcggaaccgacttcaccctgacaatcagctctgtgcaggccgaggacctggccgtgtattactgccagaacgactacagctaccctctgacctttggagccggcaccaagctggaactgaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaaggcgagatcaaccaccggggcaacaccaacgacaaccccagcctgaaaagcagagtgaccatcagcgtggacaccagcaagaaccagttcgccctgaagctgagcagcgtgacagccgctgataccgccgtgtattattgcgccagagagcggggctacacctacggcaatttcgatcactggggccagggcaccctggtcacagtttcttctggcgagatcaaccaccggggcaacaccaacgacaaccccagcctgaaaagcagagtgaccatcagcgtggacaccagcaagaaccagttcgccctgaagctgagcagcgtgacagccgctgataccgccgtgtattattgcgccagagagcggggctacacctacggcaatttcgatcactggggccagggcaccctggtcacagtttcttctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3519 - DNA, 3393 bp, Artificial Sequence
  Synthetic Polynucleotide encoding a CAR with optional accessory module(s)
atggccttaccagtgaccgccttgctcctgccgctggccttgctgctccacgccgccaggccgtcttctgagctgacacaggaccctgccgtgtctgttgctctgggccagacagtgcggattacctgtcagggcgatagcctgagaagctactacgcctcctggtatcagcagaagccaggccaggctcctgtgctggtcatctacggcaagaacaacagacccagcggcatccccgatagattcagcggaagcagctctggcaataccgccagcctgacaattactggcgctcaggccgaggacgaggccgactactactgcaacagcagagatagcagcggctgggttttcggcggaggcacaaaactgacagtgctgctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtgcaactggttgagtctggcggaggactggtgcagcctggaagaagcctgagactgtcttgtgccgccagcggcttcaccttcgacgattatgccatgcactgggtccgacaggcccctggcaaaggacttgaatgggtgtccggcatctcctggaacagcggctctatcggctacgccgattccgtgaagggcagattcaccatcagccgggacaacgccaagaacagcctgtacctccagatgaactccctgagagccgaggacacagccctgtactactgcgccaaagacaaaggcggaggctactacgacttttggagcggcagcgattattggggccagggcacactggtcacagtgtctagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3520 - DNA, 3420 bp, Artificial Sequence
  Synthetic Polynucleotide encoding a CAR with optional accessory module(s)
atggccttaccagtgaccgccttgctcctgccgctggccttgctgctccacgccgccaggccgcaatctgctctgacacagcctgccagcgtgtcaggatctcctggacagagcatcaccatctcttgcaccggcaccagctctgatgtcggcggctacaattacgtgtcctggtatcagcagcaccccggcaaggcccctaagctgatgatctacgacgtgtccaacagacccagcggcgtgtccaatagattctccggcagcaagagcggcaacaccgccagcctgacaatttctggactgcaagccgaggacgaggccgactactactgtagcagctacaccagcagcagcacactggtgtacgtgttcggcacaggcaccaaagtgaccgtgcttctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctccagcagtctggacctggcctggttaagcctagccagacactgagcctgacctgtgccatcagcggcgatagcgtgctgagcaacagcgacacctggaactggatcagacagagccctagcagaggactggaatggctgggcagaacctaccacagaagcacttggtacgacgactacgccagctctgtgcggggcagagtgtccatcaatgtggacaccagcaagaaccagtacagcctgcaactgaacgccgtgacacctgaggataccggcgtgtactactgcgccagagacagactccaggacggcaactcttggagcgacgcctttgatgtgtggggccagggcacaatggtcaccgtttctagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3521 - DNA, 3399 bp, Artificial Sequence
  Synthetic Polynucleotide encoding a CAR with optional accessory module(s)
atggccttaccagtgaccgccttgctcctgccgctggccttgctgctccacgccgccaggccgcaatctgtgctgacccagcctagatccgtgtctggctctcctggacagagcgtgaccatctcttgtaccggcaccagctctgatgtcggcggctacaattacgtgtcctggtatcagcagcaccccggcgaagcccctaagctgattatctacgacgccgacaagcggcccagcggcatcagcaatagattcagctctggcaagagcggcaacaccgccagcctgacaatcagcggactccaggtggaagatgaggccgactactactgctgctcctatgccggcggaagcacctgggttttcggaggcggtacaaaagtgaccgtgctgctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggtgcaactggttcagtctggggccgaagtgaagaaacctggggcctctgtgaaggtgtcctgcaaggcttccggctacacctttaccagctacgacatcaactgggtccgacaggccacaggccaaggactggaatggatgggctggatgaaccccaacagcggcaataccggctacgcccagaaattccagggcagagtgaccatgaccagaaacaccagcatcagcaccgcctacatggaactgagcagcctgagaagcgaggacaccgccgtgtactattgcgccagaggcgacagcaactactggtcctactacggcatggacgtgtggggccagggaacactggttacagtttctagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3522 - DNA, 3420 bp, Artificial Sequence
  Synthetic Polynucleotide encoding a CAR with optional accessory module(s)
atggccttaccagtgaccgccttgctcctgccgctggccttgctgctccacgccgccaggccgcaatctgctctgacacagcctgccagcgtgtcaggatctcctggacagagcatcaccatctcttgcaccggcaccagctctgatgtcggcggctacaattacgtgtcctggtatcagcagcaccccggcaaggcccctaaagtgattatcagcgaagtgaacaacagacccagcggcgtgtcccacagattcagcggctctaagtctggcaacaccgccagcctgacaatctctggactgcaagccgaggacgaggccgactacttctgtagcagctacaccagcggcagaaccctgtacgtgttcggcacaggcagcaaagtgacagtgctgggactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctccagcagtctggacctggcctggttaagcctagccagacactgagcctgacctgtgccatcagcggcgatagcgtgtcctctaatagcgccgcctggaactggatcagacagagccctagcagaggactggaatggctgggcagaacctactaccgcagcaagtggtacagcgactacgccgtgtccgtgaagtcccggatcaccatcaatcccgacaccagcaagaaccagttcagcctgcaactgaacagcgtgacccctgaggataccgccgtgtactactgcgccagagatccctacgacttttggagcggctaccccgacgcctttgacatctggggacagggcacaatggtcaccgtttctagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3523 - DNA, 3417 bp, Artificial Sequence
  Synthetic Polynucleotide encoding a CAR with optional accessory module(s)
atggccttaccagtgaccgccttgctcctgccgctggccttgctgctccacgccgccaggccggaagtgcagctccagcagtctggacctggcctggttaagcctagccagacactgagcctgacctgtgccatcagcggcgattccatgctgagcaacagcgacacctggaactggatcagacagagccccagcagaggcctggaatggctgggcagaacataccacagaagcacttggtacgacgactacgccagctctgtgcggggcagagtgtccatcaatgtggacaccagcaagaaccagtacagcctgcaactgaacgccgtgacacctgaggataccggcgtgtactactgtgccagagtgcggctccaggacggcaattcttggagcgacgcctttgatgtgtggggccagggcacaatggtcaccgtttctagcctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaatctgctctgacacagcctgccagcgcctctggatctcctggacagagcgtgaccatctcctgtaccggcacctcttctgatgtcggcggctacaactacgtgtcctggtatcagcagcaccccggcaaggcccctaagctgatgatctacgacgtgtccaacagacccagcggcgtgtccaatagattctccggcagcaagagcggcaacaccgccagcctgacaatttctggactgcaagccgaggacgaggccgactactactgtagcagctacaccagcagcagcacactgtacgtgttcggcacaggcacccagctcacagttcttacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 3524 - DNA, 2022 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggtcaaggaacctcagtcaccgtctcctcacgcgtagacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3525 - DNA, 1350 bp, Artificial Sequence
  Synthetic Polynucleotide encoding a CAR with optional accessory module(s)
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggtcaaggaacctcagtcaccgtctcctcacgcgtagacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatc

SEQ ID NO: 3526 - DNA, 1911 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtatggcctccgaggacatctacatccggctggcctggtatcagcagaagcctggaaacgcccctaagctgctgatctacgccgccacctctctggaaacaggcgtgccaagcagattttccggcagcggctctggcaccgatttcaccctgacaatatccagcctccagcctgaggacttcgccacctactactgccagcagtattggagcagcccctggacatttggcggaggcaccaaggtggaaatcaaaggcggaggcggaagtggaggcggaggatctggcggcggaggctctcaggttcagctgcaagagtctggccccggactggtcaagcctagccaaacactgagcctgacctgtaccgtgtccggctacagcatcaccagcgactacacctggaactggatcagacagcctcctggcaacggactggaatggatcggctacatcacctacagcggcagcaccagctacaaccccagcctgaaaagccgggtgctgatctccgtggacaccagcaagaatcaggtgtccctgaagctgagcagcgtgacagccgctgataccgccgtgtactactgtgccagactggggagaagatacacaatggactactggggccagggcaccaccgtgacagtttcttctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3527 - DNA, 1242 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtatggcctccgaggacatctacatccggctggcctggtatcagcagaagcctggaaacgcccctaagctgctgatctacgccgccacctctctggaaacaggcgtgccaagcagattttccggcagcggctctggcaccgatttcaccctgacaatatccagcctccagcctgaggacttcgccacctactactgccagcagtattggagcagcccctggacatttggcggaggcaccaaggtggaaatcaaaggcggaggcggaagtggaggcggaggatctggcggcggaggctctcaggttcagctgcaagagtctggccccggactggtcaagcctagccaaacactgagcctgacctgtaccgtgtccggctacagcatcaccagcgactacacctggaactggatcagacagcctcctggcaacggactggaatggatcggctacatcacctacagcggcagcaccagctacaaccccagcctgaaaagccgggtgctgatctccgtggacaccagcaagaatcaggtgtccctgaagctgagcagcgtgacagccgctgataccgccgtgtactactgtgccagactggggagaagatacacaatggactactggggccagggcaccaccgtgacagtttcttctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtga

SEQ ID NO: 3528 - DNA, 2016 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtatggcctccgaggacatctacatccggctggcctggtatcagcagaagcctggaaacgcccctaagctgctgatctacgccgccacctctctggaaacaggcgtgccaagcagattttccggcagcggctctggcaccgatttcaccctgacaatatccagcctccagcctgaggacttcgccacctactactgccagcagtattggagcagcccctggacatttggcggaggcaccaaggtggaaatcaaaggcggaggcggaagtggaggcggaggatctggcggcggaggctctcaggttcagctgcaagagtctggccccggactggtcaagcctagccaaacactgagcctgacctgtaccgtgtccggctacagcatcaccagcgactacacctggaactggatcagacagcctcctggcaacggactggaatggatcggctacatcacctacagcggcagcaccagctacaaccccagcctgaaaagccgggtgctgatctccgtggacaccagcaagaatcaggtgtccctgaagctgagcagcgtgacagccgctgataccgccgtgtactactgtgccagactggggagaagatacacaatggactactggggccagggcaccaccgtgacagtttcttctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3529 - DNA, 1347 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtatggcctccgaggacatctacatccggctggcctggtatcagcagaagcctggaaacgcccctaagctgctgatctacgccgccacctctctggaaacaggcgtgccaagcagattttccggcagcggctctggcaccgatttcaccctgacaatatccagcctccagcctgaggacttcgccacctactactgccagcagtattggagcagcccctggacatttggcggaggcaccaaggtggaaatcaaaggcggaggcggaagtggaggcggaggatctggcggcggaggctctcaggttcagctgcaagagtctggccccggactggtcaagcctagccaaacactgagcctgacctgtaccgtgtccggctacagcatcaccagcgactacacctggaactggatcagacagcctcctggcaacggactggaatggatcggctacatcacctacagcggcagcaccagctacaaccccagcctgaaaagccgggtgctgatctccgtggacaccagcaagaatcaggtgtccctgaagctgagcagcgtgacagccgctgataccgccgtgtactactgtgccagactggggagaagatacacaatggactactggggccagggcaccaccgtgacagtttcttctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctga

SEQ ID NO: 3530 - DNA, 1941 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtatggcctccgaggacatctacatccggctggcctggtatcagcagaagcctggaaacgcccctaagctgctgatctacgccgccacctctctggaaacaggcgtgccaagcagattttccggcagcggctctggcaccgatttcaccctgacaatatccagcctccagcctgaggacttcgccacctactactgccagcagtattggagcagcccctggacatttggcggaggcaccaaggtggaaatcaaaggcggaggcggaagtggaggcggaggatctggcggcggaggctctcaggttcagctgcaagagtctggccccggactggtcaagcctagccaaacactgagcctgacctgtaccgtgtccggctacagcatcaccagcgactacacctggaactggatcagacagcctcctggcaacggactggaatggatcggctacatcacctacagcggcagcaccagctacaaccccagcctgaaaagccgggtgctgatctccgtggacaccagcaagaatcaggtgtccctgaagctgagcagcgtgacagccgctgataccgccgtgtactactgtgccagactggggagaagatacacaatggactactggggccagggcaccaccgtgacagtttcttctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3531 - DNA, 1272 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtatggcctccgaggacatctacatccggctggcctggtatcagcagaagcctggaaacgcccctaagctgctgatctacgccgccacctctctggaaacaggcgtgccaagcagattttccggcagcggctctggcaccgatttcaccctgacaatatccagcctccagcctgaggacttcgccacctactactgccagcagtattggagcagcccctggacatttggcggaggcaccaaggtggaaatcaaaggcggaggcggaagtggaggcggaggatctggcggcggaggctctcaggttcagctgcaagagtctggccccggactggtcaagcctagccaaacactgagcctgacctgtaccgtgtccggctacagcatcaccagcgactacacctggaactggatcagacagcctcctggcaacggactggaatggatcggctacatcacctacagcggcagcaccagctacaaccccagcctgaaaagccgggtgctgatctccgtggacaccagcaagaatcaggtgtccctgaagctgagcagcgtgacagccgctgataccgccgtgtactactgtgccagactggggagaagatacacaatggactactggggccagggcaccaccgtgacagtttcttctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactga

SEQ ID NO: 3532 - DNA, 1890 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtatggcctccgaggacatctacatccggctggcctggtatcagcagaagcctggaaacgcccctaagctgctgatctacgccgccacctctctggaaacaggcgtgccaagcagattttccggcagcggctctggcaccgatttcaccctgacaatatccagcctccagcctgaggacttcgccacctactactgccagcagtattggagcagcccctggacatttggcggaggcaccaaggtggaaatcaaaggcggaggcggaagtggaggcggaggatctggcggcggaggctctcaggttcagctgcaagagtctggccccggactggtcaagcctagccaaacactgagcctgacctgtaccgtgtccggctacagcatcaccagcgactacacctggaactggatcagacagcctcctggcaacggactggaatggatcggctacatcacctacagcggcagcaccagctacaaccccagcctgaaaagccgggtgctgatctccgtggacaccagcaagaatcaggtgtccctgaagctgagcagcgtgacagccgctgataccgccgtgtactactgtgccagactggggagaagatacacaatggactactggggccagggcaccaccgtgacagtttcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3533 - DNA, 1221 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtatggcctccgaggacatctacatccggctggcctggtatcagcagaagcctggaaacgcccctaagctgctgatctacgccgccacctctctggaaacaggcgtgccaagcagattttccggcagcggctctggcaccgatttcaccctgacaatatccagcctccagcctgaggacttcgccacctactactgccagcagtattggagcagcccctggacatttggcggaggcaccaaggtggaaatcaaaggcggaggcggaagtggaggcggaggatctggcggcggaggctctcaggttcagctgcaagagtctggccccggactggtcaagcctagccaaacactgagcctgacctgtaccgtgtccggctacagcatcaccagcgactacacctggaactggatcagacagcctcctggcaacggactggaatggatcggctacatcacctacagcggcagcaccagctacaaccccagcctgaaaagccgggtgctgatctccgtggacaccagcaagaatcaggtgtccctgaagctgagcagcgtgacagccgctgataccgccgtgtactactgtgccagactggggagaagatacacaatggactactggggccagggcaccaccgtgacagtttcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatga

SEQ ID NO: 3534 - DNA, 2628 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtatggcctccgaggacatctacatccggctggcctggtatcagcagaagcctggaaacgcccctaagctgctgatctacgccgccacctctctggaaacaggcgtgccaagcagattttccggcagcggctctggcaccgatttcaccctgacaatatccagcctccagcctgaggacttcgccacctactactgccagcagtattggagcagcccctggacatttggcggaggcaccaaggtggaaatcaaaggcggaggcggaagtggaggcggaggatctggcggcggaggctctcaggttcagctgcaagagtctggccccggactggtcaagcctagccaaacactgagcctgacctgtaccgtgtccggctacagcatcaccagcgactacacctggaactggatcagacagcctcctggcaacggactggaatggatcggctacatcacctacagcggcagcaccagctacaaccccagcctgaaaagccgggtgctgatctccgtggacaccagcaagaatcaggtgtccctgaagctgagcagcgtgacagccgctgataccgccgtgtactactgtgccagactggggagaagatacacaatggactactggggccagggcaccaccgtgacagtttcttctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatcagggccaagcgatctggatctggagcaacaaacttctcactactcaaacaagcaggtgacgtggaggagaatcccgggccttctagtatggactggatttggcgcatccttttccttgtcggcgctgctaccggcgcgcattccttcgaaggcggactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3535 - DNA, 2745 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtatggcctccgaggacatctacatccggctggcctggtatcagcagaagcctggaaacgcccctaagctgctgatctacgccgccacctctctggaaacaggcgtgccaagcagattttccggcagcggctctggcaccgatttcaccctgacaatatccagcctccagcctgaggacttcgccacctactactgccagcagtattggagcagcccctggacatttggcggaggcaccaaggtggaaatcaaaggcggaggcggaagtggaggcggaggatctggcggcggaggctctcaggttcagctgcaagagtctggccccggactggtcaagcctagccaaacactgagcctgacctgtaccgtgtccggctacagcatcaccagcgactacacctggaactggatcagacagcctcctggcaacggactggaatggatcggctacatcacctacagcggcagcaccagctacaaccccagcctgaaaagccgggtgctgatctccgtggacaccagcaagaatcaggtgtccctgaagctgagcagcgtgacagccgctgataccgccgtgtactactgtgccagactggggagaagatacacaatggactactggggccagggcaccaccgtgacagtttcttctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatcagggccaagcgatctggatctggagcaacaaacttctcactactcaaacaagcaggtgacgtggaggagaatcccgggccttctagtatggactggatttggcgcatccttttccttgtcggcgctgctaccggcgcgcattccttcgaaggcggaacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggacgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3536 - DNA, 2628 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtatggcctccgaggacatctacatccggctggcctggtatcagcagaagcctggaaacgcccctaagctgctgatctacgccgccacctctctggaaacaggcgtgccaagcagattttccggcagcggctctggcaccgatttcaccctgacaatatccagcctccagcctgaggacttcgccacctactactgccagcagtattggagcagcccctggacatttggcggaggcaccaaggtggaaatcaaaggcggaggcggaagtggaggcggaggatctggcggcggaggctctcaggttcagctgcaagagtctggccccggactggtcaagcctagccaaacactgagcctgacctgtaccgtgtccggctacagcatcaccagcgactacacctggaactggatcagacagcctcctggcaacggactggaatggatcggctacatcacctacagcggcagcaccagctacaaccccagcctgaaaagccgggtgctgatctccgtggacaccagcaagaatcaggtgtccctgaagctgagcagcgtgacagccgctgataccgccgtgtactactgtgccagactggggagaagatacacaatggactactggggccagggcaccaccgtgacagtttcttctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatcagggccaagcgatctggatctggagcaacaaacttctcactactcaaacaagcaggtgacgtggaggagaatcccgggccttctagtatggactggatttggcgcatccttttccttgtcggcgctgctaccggcgcgcattccttcgaaggcggactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3537 - DNA, 2046 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtatggcctccgaggacatctacatccggctggcctggtatcagcagaagcctggaaacgcccctaagctgctgatctacgccgccacctctctggaaacaggcgtgccaagcagattttccggcagcggctctggcaccgatttcaccctgacaatatccagcctccagcctgaggacttcgccacctactactgccagcagtattggagcagcccctggacatttggcggaggcaccaaggtggaaatcaaaggcggaggcggaagtggaggcggaggatctggcggcggaggctctcaggttcagctgcaagagtctggccccggactggtcaagcctagccaaacactgagcctgacctgtaccgtgtccggctacagcatcaccagcgactacacctggaactggatcagacagcctcctggcaacggactggaatggatcggctacatcacctacagcggcagcaccagctacaaccccagcctgaaaagccgggtgctgatctccgtggacaccagcaagaatcaggtgtccctgaagctgagcagcgtgacagccgctgataccgccgtgtactactgtgccagactggggagaagatacacaatggactactggggccagggcaccaccgtgacagtttcttctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatcagggccaagcgatctggatctggagcaacaaacttctcactactcaaacaagcaggtgacgtggaggagaatcccgggccttctagtatggactggatttggcgcatccttttccttgtcggcgctgctaccggcgcgcattccttcgaaggcggaacgcgtgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 3538 - DNA, 1929 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtatggcctccgaggacatctacatccggctggcctggtatcagcagaagcctggaaacgcccctaagctgctgatctacgccgccacctctctggaaacaggcgtgccaagcagattttccggcagcggctctggcaccgatttcaccctgacaatatccagcctccagcctgaggacttcgccacctactactgccagcagtattggagcagcccctggacatttggcggaggcaccaaggtggaaatcaaaggcggaggcggaagtggaggcggaggatctggcggcggaggctctcaggttcagctgcaagagtctggccccggactggtcaagcctagccaaacactgagcctgacctgtaccgtgtccggctacagcatcaccagcgactacacctggaactggatcagacagcctcctggcaacggactggaatggatcggctacatcacctacagcggcagcaccagctacaaccccagcctgaaaagccgggtgctgatctccgtggacaccagcaagaatcaggtgtccctgaagctgagcagcgtgacagccgctgataccgccgtgtactactgtgccagactggggagaagatacacaatggactactggggccagggcaccaccgtgacagtttcttctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatcagggccaagcgatctggatctggagcaacaaacttctcactactcaaacaagcaggtgacgtggaggagaatcccgggccttctagtatggactggatttggcgcatccttttccttgtcggcgctgctaccggcgcgcattccttcgaaggcggactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctga

SEQ ID NO: 3539 - DNA, 1971 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtatggcctccgaggacatctacatccggctggcctggtatcagcagaagcctggaaacgcccctaagctgctgatctacgccgccacctctctggaaacaggcgtgccaagcagattttccggcagcggctctggcaccgatttcaccctgacaatatccagcctccagcctgaggacttcgccacctactactgccagcagtattggagcagcccctggacatttggcggaggcaccaaggtggaaatcaaaggcggaggcggaagtggaggcggaggatctggcggcggaggctctcaggttcagctgcaagagtctggccccggactggtcaagcctagccaaacactgagcctgacctgtaccgtgtccggctacagcatcaccagcgactacacctggaactggatcagacagcctcctggcaacggactggaatggatcggctacatcacctacagcggcagcaccagctacaaccccagcctgaaaagccgggtgctgatctccgtggacaccagcaagaatcaggtgtccctgaagctgagcagcgtgacagccgctgataccgccgtgtactactgtgccagactggggagaagatacacaatggactactggggccagggcaccaccgtgacagtttcttctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaacagggccaagcgatctggatctggagcaacaaacttctcactactcaaacaagcaggtgacgtggaggagaatcccgggccttctagtatggactggatttggcgcatccttttccttgtcggcgctgctaccggcgcgcattccttcgaaggcggaacgcgtgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 3540 - DNA, 1854 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtatggcctccgaggacatctacatccggctggcctggtatcagcagaagcctggaaacgcccctaagctgctgatctacgccgccacctctctggaaacaggcgtgccaagcagattttccggcagcggctctggcaccgatttcaccctgacaatatccagcctccagcctgaggacttcgccacctactactgccagcagtattggagcagcccctggacatttggcggaggcaccaaggtggaaatcaaaggcggaggcggaagtggaggcggaggatctggcggcggaggctctcaggttcagctgcaagagtctggccccggactggtcaagcctagccaaacactgagcctgacctgtaccgtgtccggctacagcatcaccagcgactacacctggaactggatcagacagcctcctggcaacggactggaatggatcggctacatcacctacagcggcagcaccagctacaaccccagcctgaaaagccgggtgctgatctccgtggacaccagcaagaatcaggtgtccctgaagctgagcagcgtgacagccgctgataccgccgtgtactactgtgccagactggggagaagatacacaatggactactggggccagggcaccaccgtgacagtttcttctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaacagggccaagcgatctggatctggagcaacaaacttctcactactcaaacaagcaggtgacgtggaggagaatcccgggccttctagtatggactggatttggcgcatccttttccttgtcggcgctgctaccggcgcgcattccttcgaaggcggactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctga

SEQ ID NO: 3541 - DNA, 1941 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtatggcctccgaggacatctacatccggctggcctggtatcagcagaagcctggaaacgcccctaagctgctgatctacgccgccacctctctggaaacaggcgtgccaagcagattttccggcagcggctctggcaccgatttcaccctgacaatatccagcctccagcctgaggacttcgccacctactactgccagcagtattggagcagcccctggacatttggcggaggcaccaaggtggaaatcaaaggcggaggcggaagtggaggcggaggatctggcggcggaggctctcaggttcagctgcaagagtctggccccggactggtcaagcctagccaaacactgagcctgacctgtaccgtgtccggctacagcatcaccagcgactacacctggaactggatcagacagcctcctggcaacggactggaatggatcggctacatcacctacagcggcagcaccagctacaaccccagcctgaaaagccgggtgctgatctccgtggacaccagcaagaatcaggtgtccctgaagctgagcagcgtgacagccgctgataccgccgtgtactactgtgccagactggggagaagatacacaatggactactggggccagggcaccaccgtgacagtttcttctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagagggccaagcgatctggatctggagcaacaaacttctcactactcaaacaagcaggtgacgtggaggagaatcccgggccttctagtatggactggatttggcgcatccttttccttgtcggcgctgctaccggcgcgcattccttcgaaggcggaacgcgtgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 3542 - DNA, 1824 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtatggcctccgaggacatctacatccggctggcctggtatcagcagaagcctggaaacgcccctaagctgctgatctacgccgccacctctctggaaacaggcgtgccaagcagattttccggcagcggctctggcaccgatttcaccctgacaatatccagcctccagcctgaggacttcgccacctactactgccagcagtattggagcagcccctggacatttggcggaggcaccaaggtggaaatcaaaggcggaggcggaagtggaggcggaggatctggcggcggaggctctcaggttcagctgcaagagtctggccccggactggtcaagcctagccaaacactgagcctgacctgtaccgtgtccggctacagcatcaccagcgactacacctggaactggatcagacagcctcctggcaacggactggaatggatcggctacatcacctacagcggcagcaccagctacaaccccagcctgaaaagccgggtgctgatctccgtggacaccagcaagaatcaggtgtccctgaagctgagcagcgtgacagccgctgataccgccgtgtactactgtgccagactggggagaagatacacaatggactactggggccagggcaccaccgtgacagtttcttctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagagggccaagcgatctggatctggagcaacaaacttctcactactcaaacaagcaggtgacgtggaggagaatcccgggccttctagtatggactggatttggcgcatccttttccttgtcggcgctgctaccggcgcgcattccttcgaaggcggactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctga

SEQ ID NO: 3543 - DNA, 1920 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtatggcctccgaggacatctacatccggctggcctggtatcagcagaagcctggaaacgcccctaagctgctgatctacgccgccacctctctggaaacaggcgtgccaagcagattttccggcagcggctctggcaccgatttcaccctgacaatatccagcctccagcctgaggacttcgccacctactactgccagcagtattggagcagcccctggacatttggcggaggcaccaaggtggaaatcaaaggcggaggcggaagtggaggcggaggatctggcggcggaggctctcaggttcagctgcaagagtctggccccggactggtcaagcctagccaaacactgagcctgacctgtaccgtgtccggctacagcatcaccagcgactacacctggaactggatcagacagcctcctggcaacggactggaatggatcggctacatcacctacagcggcagcaccagctacaaccccagcctgaaaagccgggtgctgatctccgtggacaccagcaagaatcaggtgtccctgaagctgagcagcgtgacagccgctgataccgccgtgtactactgtgccagactggggagaagatacacaatggactactggggccagggcaccaccgtgacagtttcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagaagggccaagcgatctggatctggagcaacaaacttctcactactcaaacaagcaggtgacgtggaggagaatcccgggccttctagtatggactggatttggcgcatccttttccttgtcggcgctgctaccggcgcgcattccttcgaaggcggaacgcgtgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 3544 - DNA, 1803 bp, Artificial Sequence
  Synthetic Polynucleotide encoding a CAR with optional accessory module(s)
atggccttaccagtgaccgccttgctcctgccgctggccttgctgctccacgccgccaggccggacgtggtcatgacacagagcccttctagcctgtctgccagcgtgggcgacagagtgaccatcacctgtatggcctccgaggacatctacatccggctggcctggtatcagcagaagcctggaaacgcccctaagctgctgatctacgccgccacctctctggaaacaggcgtgccaagcagattttccggcagcggctctggcaccgatttcaccctgacaatatccagcctccagcctgaggacttcgccacctactactgccagcagtattggagcagcccctggacatttggcggaggcaccaaggtggaaatcaaaggcggaggcggaagtggaggcggaggatctggcggcggaggctctcaggttcagctgcaagagtctggccccggactggtcaagcctagccaaacactgagcctgacctgtaccgtgtccggctacagcatcaccagcgactacacctggaactggatcagacagcctcctggcaacggactggaatggatcggctacatcacctacagcggcagcaccagctacaaccccagcctgaaaagccgggtgctgatctccgtggacaccagcaagaatcaggtgtccctgaagctgagcagcgtgacagccgctgataccgccgtgtactactgtgccagactggggagaagatacacaatggactactggggccagggcaccaccgtgacagtttcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagaagggccaagcgatctggatctggagcaacaaacttctcactactcaaacaagcaggtgacgtggaggagaatcccgggccttctagtatggactggatttggcgcatccttttccttgtcggcgctgctaccggcgcgcattccttcgaaggcggactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctga

SEQ ID NO: 3545 - DNA, 1719 bp, Artificial Sequence
  Synthetic Polynucleotide encoding a Bispecific antibody
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggtcaaggaacctcagtcaccgtctcctcacgcgtaacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3546 - DNA, 1719 bp, Artificial Sequence
  Synthetic Polynucleotide encoding a Bispecific antibody
atggccttaccagtgaccgccttgctcctgccgctggccttgctgctccacgccgccaggccggagatcgtgatgacccagagccctgccaccctgtctctgagccctggcgaaagagccaccctgagctgtagagccagccaggacatcagcaagtacctgaactggtatcagcagaagcccggccaggcccccagactgctgatctaccacaccagcagactgcacagcggcatccccgccagattttctggctctggcagcggcaccgactacaccctgacaatcagcagcctccagcccgaggacttcgccgtgtacttctgtcagcaaggcaacaccctgccctacaccttcggccagggcaccaagctggaaatcaagggcggaggcggaagtggaggcggaggatctggcggcggaggctctcaggtgcaactccaggaatctggccctggcctcgtgaagcccagcgagacactgagcctgacctgtaccgtgtccggcgtgtccctgcctgactatggcgtgtcctggatcagacagccccctggcaagggcctggaatggatcggagtgatttggggcagcgaaaccacctactacaacagctccctgaagtccagagtgaccatctccaaggacaactccaagaaccaggtgtccctgaagctgagcagcgtgacagccgccgacaccgccgtgtattactgcgccaagcactactactacggcggcagctacgctatggactactggggccagggaaccctcgtgaccgtgtctagtacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3547 - DNA, 1719 bp, Artificial Sequence
  Synthetic Polynucleotide encoding a Bispecific antibody
atggccttaccagtgaccgccttgctcctgccgctggccttgctgctccacgccgccaggccggagatcgtgatgacccagagccctgccaccctgtctctgagccctggcgaaagagccaccctgagctgtagagccagccaggacatcagcaagtacctgaactggtatcagcagaagcccggccaggcccccagactgctgatctaccacaccagcagactgcacagcggcatccccgccagattttctggctctggcagcggcaccgactacaccctgacaatcagcagcctccagcccgaggacttcgccgtgtacttctgtcagcaaggcaacaccctgccctacaccttcggccagggcaccaagctggaaatcaagggcggaggcggaagtggaggcggaggatctggcggcggaggctctcaggtgcaactccaggaatctggccctggcctcgtgaagcccagcgagacactgagcctgacctgtaccgtgtccggcgtgtccctgcctgactatggcgtgtcctggatcagacagccccctggcaagggcctggaatggatcggagtgatttggggcagcgaaaccacctactaccaaagctccctgaagtccagagtgaccatctccaaggacaactccaagaaccaggtgtccctgaagctgagcagcgtgacagccgccgacaccgccgtgtattactgcgccaagcactactactacggcggcagctacgctatggactactggggccagggaaccctcgtgaccgtgtctagtacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3548 - DNA, 1722 bp, Artificial Sequence
  Synthetic Polynucleotide encoding a Bispecific antibody
atggccttaccagtgaccgccttgctcctgccgctggccttgctgctccacgccgccaggccggacgagatcgtgctgacacagagccccgccaccctgtcactgtctccaggcgaaagagccaccctgagctgtagcgccagcagcagcgtgtcctacatgcactggtatcagcagaagcccggccaggcccccagactgctgatctacgataccagcaagctggcctccggcatccccgccagattttctggcagcggctccggcaccgacttcaccctgacaatcagcagcctggaacccgaggacgtggccgtgtactactgttttcaaggcagcgtgtaccccttcaccttcggccagggcaccaagctggaaatcaagagaggtggcggtggctcgggcggtggtgggtcgggtggcggcggatctcaggtgcagctccaggaatctggccctggcctcgtgaagcctagccagaccctgagcctgacctgtaccgtgtctggcggcagcatcagcacaagcggcatgggcgtgggctggatcagacagcaccctggcaagggcctggaatggatcggccacatttggtgggacgacgacaagcggtacaaccccgccctgaagtccagagtgaccatcagcgtggacaccagcaagaaccagttcagcctgaagctgagcagcgtgacagccgccgataccgccgtgtattattgcgcccggatggaactgtggtcctactacttcgactactggggccagggaaccctcgtgaccgtgtctagtacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3549 - DNA, 1743 bp, Artificial Sequence
  Synthetic Polynucleotide encoding a Bispecific antibody
atggccctgcctgtgacagctctgctgctgcctctggcactgctgctgcacgccgccagacctgacatccagctgacacagagccctgccagcctggccgtgtctctgggacagagagccaccatcagctgcaaggccagccagagcgtggactacgacggcgacagctacctgaactggtatcagcagatccccggccagccccccaagctgctgatctacgatgccagcaacctggtgtccggcatcccccctagattttccggcagcggctccggcaccgacttcaccctgaatatccaccccgtggaaaaggtggacgccgccacctaccactgccagcagagcaccgaagatccctggacctttggcggaggcaccaagctggaaatcaagggaggcggaggaagtggcggcggaggatctgggggaggcggaagccaggtacagctccaacagtcaggggccgagctggtacgcccagggtccagcgtcaaaatatcatgtaaggcatctggctacgccttcagctcttactggatgaattgggtgaaacaacggccaggccagggactggagtggattggtcaaatttggccaggagacggggacacaaattacaacggaaaattcaagggaaaggccacacttaccgccgatgaaagtagttcaaccgcttatatgcagctgtcctccctcgcttctgaggactctgctgtgtacttttgcgcacgccgagaaaccaccactgtgggaagatactactacgctatggattattggggacagggcacaaccgtgaccgttagcagtacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3550 - DNA, 1740 bp, Artificial Sequence
  Synthetic Polynucleotide encoding a Bispecific antibody
atggccttaccagtgaccgccttgctcctgccgctggccttgctgctccacgccgccaggccggacatcgtgatgacccaggccgctcccagcatccctgtgacacctggcgagagcgtgtccatctcctgccggtctagcaagagcctgctgaacagcaacggcaatacctacctgtactggttcctccagcggccaggccagtctccccaactgctgatctaccggatgagcaacctggcctccggcgtgcccgatagattttctggcagcggctccggcaccgccttcaccctgagaatcagcagagtggaagccgaggacgtgggcgtgtactactgtatgcagcacctggaataccccttcaccttcggagccggcaccaagctggaactgaagagaggcggaggcggaagtggaggcggaggatctggcggcggaggctctgaagtgcaactccagcagagcggccctgagctgattaagcctggggccagcgtgaagatgagctgcaaggccagcggctacaccttcaccagctacgtgatgcactgggtcaagcagaagcccggccagggcctggaatggatcggctacatcaacccctacaacgatggcaccaagtacaacgagaagttcaagggcaaggccaccctgaccagcgacaagagcagcagcaccgcctacatggaactgagcagcctgacaagcgaggacagcgccgtgtactattgcgccagaggcacctactactacggcagccgggtgttcgactattggggccagggcaccacactgaccgtgtcctctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3551 - DNA, 1734 bp, Artificial Sequence
  Synthetic Polynucleotide encoding a Bispecific antibody
atggccttaccagtgaccgccttgctcctgccgctggccttgctgctccacgccgccaggccggagatcgtgctgacacagagccccgatttccagagcgtgacccctaaagaaaaagtgaccatcacctgtcgggccagcgagagcgtggacacattcggcatcagcttcatgaactggttccagcagaagcccgatcagagccccaagctgctgattcacgccgccagcaatcaaggcagcggagtgcctagcagattttccggctctggcagcggcaccgatttcaccctgaccatcaatagcctggaagccgaggatgccgccacctactactgccagcagagcaaagaggtgcccttcacctttggcggaggcaccaaggtggaaatcaaaggcggaggcggaagtggaggcggaggatctggcggcggaggctctgaagtgcagctcgttgagtctggtggcggactggttcaacctggcggaagcctgagactgtcttgtgccgccagcggcttcaccttcagcagctcttggatgaactgggtccgacaggcccctggcaaaggactggaatgggtcggaagaatctaccccggcgacggcgacaccaactacaacggcaagttcaagggcagattcaccatcagccgggacgacagcaagaacagcctgtacctgcagatgaactccctgaaaaccgaggacaccgccgtgtactactgtgccagatccggcttcatcaccaccgtgctggacttcgattattggggccagggcaccctggtcaccgtttcttctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3552 - DNA, 1722 bp, Artificial Sequence
  Synthetic Polynucleotide encoding a Bispecific antibody
atggccttaccagtgaccgccttgctcctgccgctggccttgctgctccacgccgccaggccggccattcagctcacacagagcccttctagcctgagcgcctctgtgggcgacagagtgaccatcacatgtagagccagccagggcatcagcagcgcccagcagaaacctggaaaggcccctaagctgctgatcctggcctggtacagcagcctggaaagcggagtgcctagcagattcagcggctacgatgcctctggcagcggcaccgatttcaccctgacaatatccagcctccagcctgaggacttcgccacctactactgccagcagttcaacagctacccctacaccttcggccagggcaccaagctggaaatcaaaggcggaggcggaagtggaggcggaggatctggcggcggaggctctgaagtgcaactggttcagagcggagccgaagtgaagaagcctggcgagagcctgaagattagctgcaaaggctccggctacagcttcagcagctcttggatcggctgggtccgacagatgcctggcaaaggactggaatggatgggcatcatctaccccgacgacagcgacaccagatacagccctagcttccagggccaagtgacaatcagcgccgacaagagcatcagaaccgcctacctccagtggtcctctctgaaggccagcgataccgccatgtactactgcgccagacacgtgaccatgatctggggagtgattatcgacttctggggccagggaaccctggtcacagtctcttctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3553 - DNA, 1794 bp, Artificial Sequence
  Synthetic Polynucleotide encoding a Bispecific antibody
atggccttaccagtgaccgccttgctcctgccgctggccttgctgctccacgccgccaggccgatcaacatctacaacgccgagcctgccaatcctagcgagaagaacagccccgaattcgacatcgtgatgacacagagccccgccacactgtcactgtctccaggcgaaagagccacactgagctgtcggagcagcaagagcctccagaacgtgaacggcaacacctacctgtactggttccagcagaagcccggccagtctcctcagctcctgatctacagaatgagcaacctgaacagcggcgtgcccgacagattttctggcagcggaagcggcaccgagttcaccctgaccataagcagcctggaacctgaggacttcgccgtgtactactgtatgcagcacctggaataccccatcaccttcggagccggcaccaagctggaaatcaaaggcggaggcggaagtggaggcggaggatctggcggcggaggctctgaagtgcaactggttgaatctggcggcggactggttaagcctggcggatctctgaagctgagctgtgccgccagcggctacacctttaccagctacgtgatgcactgggtccgacaggcccctggcaaaggacttgagtggatcggctacatcaacccctacaacgatggcaccaagtacaacgagaagttccagggcagagtgaccatcagctccgacaagagcatcagcaccgcctacatggaactgagcagcctgagaagcgaggataccgccatgtactattgcgccagaggcacctactactacggcaccagagtgttcgactactggggccagggaaccctggtcacagtctcttctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3554 - DNA, 1740 bp, Artificial Sequence
  Synthetic Polynucleotide encoding a Bispecific antibody
atggccttaccagtgaccgccttgctcctgccgctggccttgctgctccacgccgccaggccggacatcctgctgacacagtctcccgccacactgtcactgtctccaggcgaaagagccacactgagctgtagagccagccagagcgtggactacgacggcgacagctacctgaactggtatcagcagaagcccggccagcctcctaagctgctgatctacgatgccagcaacctggtgtctggcatccctcctagattttccggcagcggctctggcaccgatttcaccctgaccatcagcagactggaacccgaggacttcgccgtgtaccactgtcagcagagcacagaggacccctggacatttggcggaggcaccaagctggaaatcaaaggcggaggcggaagtggaggcggaggatctggcggcggaggctctcaggtgcagctggttgaatctggcggcggacttgttgagcctggcggatctctgagactgagctgcatgagcggctacgccttcagcagctactggatgaactgggtccgacagatgcccggcaaaggactggaatggatgggccagatttggcctggcgacggcgataccaactacaaccccagcctgaagtccagagtgaccatcaccgccgatgagagcaccagcaccgcctacatggaactgtctagcctgaaggccgaggatacagccgtgtacttctgcgccagacgggaaaccacaaccgtgggcagatattactacgctatggactactggggccagggcaccctggttacagtctcttctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3555 - DNA, 1731 bp, Artificial Sequence
  Synthetic Polynucleotide encoding a Bispecific antibody
atggccttaccagtgaccgccttgctcctgccgctggccttgctgctccacgccgccaggccggacatcctgctgacacagtctcccgccacactgtcactgtctccaggcgaaagagccacactgagctgtagagccagccagagcgtggacaactacggcatcagcttcatgaactggtatcagcagaagcccggccagcctcctaagctgctgatctacgccgccagcaatcaaggctctggcatccccagcagattttccggctctggaagcggcaccgacttcaccctgaccataagcagcctggaacctgaggacttcgccatgtacttttgccagcagagcaacgaggtgcccagaacctttggcggaggcaccaagctggaaatcaaaggcggaggcggaagtggaggcggaggatctggcggcggaggctctcaggtgcaactggttgagtctggcggcggacttgttgaacctggcggaagcctgagactgagctgcatgagcggctacgcctttagcagctcctggatgaactgggtccgacagatgcctggcaaaggactggaatggatgggcagaatctaccccggcgacggcgacaccaactacaacggcaagttcaaagaacgggtcaccatcaccgccgacgagagcacaagcaccgcctacatggaactgagcagcctgaaggccgaggataccgccgtgtacttctgcgccagaagcgagtattggggcaactactgggctatggactactggggccagggcacactggtcacagtgtctagcacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3556 - DNA, 1728 bp, Artificial Sequence
  Synthetic Polynucleotide encoding a Bispecific antibody
atggccttaccagtgaccgccttgctcctgccgctggccttgctgctccacgccgccaggccggacatcctgctgacacagtctcccgccacactgtcactgtctccaggcgaaagagccacactgagctgcaaggccagtcagaacgtgggcacaaacgtggcctggtatcagcagaagcctggacagcctcctaagctgctgatctacagcgccacctaccggaactctggcatccctgccagattttctggcagcggctctggcaccgagttcaccctgaccatcaccaacgtgcagagcaaggacctggccgactacttctacttctgccagtacaacagatacccctacaccagcggcggaggcaccaagctggaaatcaaaagaggcggaggcggaagtggaggcggaggatctggcggcggaggctctcaggtgcaactggttgaatcaggcggaggactggtggaacctggcggatctctgagactgagctgtatgagcggctacgccttcagcagctactggatgaactgggtccgacagatgcccggcaaaggactggaatggatgggccaaatctaccccggcgacggcgacaccaactacaacggcaagttcaagggcagagtgacaatcaccgccgacgagagcacaagcaccgcctacatggaactgagcagcctgaaggccgaggataccgccgtgtacttctgcgccagaaagaccatcagcagcgtggtggatttctacttcgacaactggggccagggcaccctggtcacagtttcttctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3557 - DNA, 1767 bp, Artificial Sequence
  Synthetic Polynucleotide encoding a Bispecific antibody
atggccttaccagtgaccgccttgctcctgccgctggccttgctgctccacgccgccaggccgatcaacatctacaacgccgagcctgccaatcctagcgagaagaacagccccgaattccagatcgtgctgacacagtctccagccacactgagcgcttctccaggcgagaaggccaccatgacatgttctgccagcagcggcgtgaactacatgcactggtatcagcagaagcccggcacaagccccaagcggtggatctacgataccgacaagacagccagcggagtgcccgccagattttctggctctggcagcggcacatcctacagcctgacaatcagcagcatggaagccgaggatgccgccacctactactgtcaccagagaggcagctacaccttcggcggaggcaccaagctggaaatcaaaggcggaggcggaagtggaggcggaggatctggcggcggaggctctcaagttcagctggaacaacctggcgctgaggtggtcaaaccaggggcctctgtgaaggtgtcctgcaagacaagcggctacacattcaccagcaactggatgcactgggtcaagcagacccctggcaaaggactggaatggatcggcgagatcgaccccagcgactcctacaccaactacaaccagaagttcgacggcaaggccaagctgaccgtggacaagtctagcagcaccgcctacatggaagtgtccgatctgaccgccgaagatagcgccacatattactgcgccagaggcagcaacccctactactacgctatggactattggggccagggcaccagcgtgacagtctcttctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3558 - DNA, 1725 bp, Artificial Sequence
  Synthetic Polynucleotide encoding a Bispecific antibody
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggacaggcccctaagctgctgatctacggcgctaccacactggaaacaggcgtgcccagcagattttctggcagcggctctggcaccgactacaccctgacaatatccagcctccagcctgaggacttcgccacctactactgtcagcagagctggaacaccccttggacattcggccagggcaccaagctggaaatcaagagaggcggaggcggaagtggaggcggaggatctggcggcggaggctctcaagttcagcttcaacagcctggcgctgagctggtcaaacctggcgcttctgtgaagatgagctgcaaagccagcggctacgccttcagcagctactggatcaactggatgaagcagaaacccggccagggactcgaatggatcggccaaatctatcccggcgacggcgacaccaactacaacggcaagttcaagggcagagccacactgaccgccgatacctctagcagcacagcctacatgcagctgagcagcctgaccagcgaagatagcgccgtgtacttctgtgcccggtccatcacaacagtcgtgggctgcgctatggactattggggccagggaacaagcgtgaccgtgtctagtacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3559 - DNA, 1749 bp, Artificial Sequence
  Synthetic Polynucleotide encoding a Bispecific antibody
atggccttaccagtgaccgccttgctcctgccgctggccttgctgctccacgccgccaggccggacgacatccagctgacccagagccccagcagcctgagcgccagcgtgggcgacagagtgaccatcacctgcaaggccagccagagcgtggactacgacggcgacagctacctgaactggtaccagcagatccccggcaaggcccccaagctgctgatctacgacgccagcaacctggtgagcggcatcccccccagattcagcggcagcggcagcggcaccgactacaccttcaccatcagcagcctgcagcccgaggacatcgccacctaccactgccagcagagcaccgaggacccctggaccttcggcggcggcaccaagctgcagatcaagagaggcggaggcggaagtggaggcggaggatctggcggcggaggctctcaggtgcagctgcagcagagcggcgccgaggtgaagaagcccggcagcagcgtgaaggtgagctgcaaggccagcggctacgccttcagcagctactggatgaactgggtgagacagagacccggccagggcctggagtggatcggccagatttggcccggcgacggcgacaccaactacaacggcaagttcaagggcagagccaccatcaccgccgacgagagcaccaacaccgcctacatggagctgagcagcctgagaagcgaggacaccgccttctacagctgcgccagaagagagaccaccaccgtgggcagatactactacgctatggactactggggccagggcaccaccgtgaccgtgagcagcacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3560 - DNA, 1722 bp, Artificial Sequence
  Synthetic Polynucleotide encoding a Bispecific antibody
atggccttaccagtgaccgccttgctcctgccgctggccttgctgctccacgccgccaggccgcagtctgtgctgacacagcctgcctctgtgtctggctctcctggccagagcatcaccatcagctgtaccggcaccagctctgatgtcggcggctacaattacgtgtcctggtatcagcagcaccccggcaaggcccctaagctgatgatctacgacgtgaacaacagacccagcgaggtgtccaacagattcagcggcagcaagagcggcaataccgccagcctgacaatctctggactgcaagccgaggacgaggccgactactactgtagcagctacaccacaggcagcagagccgtttttggcggaggcaccaaactgacagtgcttggaggcggaggcggaagtggaggcggaggatctggcggcggaggctctgaagttcagctggttcagtctggcgccgaagtgaagaagcctggcgagtctctgaccatctcctgcaaggccagcggctacagcttccccaactactggatcacctgggtccgacagatgtccggtggtggccttgagtggatgggcagaatcgatcccggcgactcctacaccacctacaatcctagcttccagggccacgtgaccatcagcatcgacaagagcaccaacaccgcctacctgcactggaacagcctgaaagccagcgacaccgccatgtactactgcgcccggtactatgtgtccctggtggacatttggggccagggcacactggtcacagtgtctagtacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3561 - DNA, 1740 bp, Artificial Sequence
  Synthetic Polynucleotide encoding a Bispecific antibody
atggccttaccagtgaccgccttgctcctgccgctggccttgctgctccacgccgccaggccgcagtctgtggtcacacagcctccatccgtgtctgctgcccctggacagaaagtgaccatctcctgtagcggcagcagcagcaacatcggcaacaactacgtgtcctggtatcagcagctccccggcacagctcccaaactgctgatctacgacaacaacaagcggcccagcggcatccccgatagattttctggcagcaagagcggcaccagcgccacactgggaattaccggacttcagacaggcgacgaggccgactactactgtggcacatgggatggcagcctgtacaccatgcttttcggcggaggcaccaagctgacagtgcttggcggaggcggaagtggaggcggaggatctggcggcggaggctctgaagtgcaactggtggaatctggcggcggactggttaagcctggcggatctctgagactgtcttgtgccgccagcggcttcaccttcagcaatgcctggatgagctgggttcgacaggcccctggaaaaggactggaatgggtcggattcatccggtccaaagcctacggcggcaccacagaatatgccgcctctgtgaagggcagattcaccatcagccgggacgacagcaagtctatcgcctacctccagatgaacaacctgaaaaccgaggacaccgccgtgtactactgcgccagagatggcctgtacagcagctcttggtacgacagcgattactggggccagggcacactggtcacagtgtcatctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3562 - DNA, 1755 bp, Artificial Sequence
  Synthetic Polynucleotide encoding a Bispecific antibody
atggccttaccagtgaccgccttgctcctgccgctggccttgctgctccacgccgccaggccgcagtctgtgctgacacagcctcctagtgtgtctggcgctcctggacagagagtgaccatctcttgtaccggcagcagcagcaatatcggagccggctatgacgtgcactggtatcagcagctccctggcacagcccctaaactgctgatcttcggcaacagcaacagacccagcggcgtgcccgatagattcagcggctttaagagcggcacaagcgccagcctggctatcactggactgcaagccgaggacgaggccgactacttctgccagagctacgatagcagcctgagcggcagcggagtgtttggcacaggcaccaaagtgacagtgcttggcggcggaggcggaagtggaggcggaggatctggcggcggaggctctcaaatgcaactggttcaaagcggcggtggcctggtgcaacctggaagaagtctgagactgagctgtgccgccagcggcttcaccttcgatgattacgccatgcactgggtccgacaggcccctggaaaaggactggaatgggtgtccggcatctcctggaatagcggctctatcggctacgccgacagcgtgaagggcagattcaccatcagccgggacaacgccaagaacagcctgtacctccagatgaactccctgagagccgaggatacagccctgtactactgcgccaaggacatccacagcggcagctactacggcctgctgtactacgctatggacgtgtggggccagggcacaaccgtgacagtttcttctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3563 - DNA, 1716 bp, Artificial Sequence
  Synthetic Polynucleotide encoding a Bispecific antibody
atggccttaccagtgaccgccttgctcctgccgctggccttgctgctccacgccgccaggccggactacatccacgtgacacagagccctagcagcctgtccgtgtccatcggcgatagagtgaccatcaactgccagacctctcaaggcgtgggcagcgacctgcactggtatcagcacaaacctggcagagcccctaagctgctgatccaccatgccagctctgtggaagatggcgtgcccagcagattttccggcaccggatttcacaccagcttcaacctgacaatcaacgacctccaggccgacgacatcggcacctactactgtcaagtgctccagagcttcggcagaggcagcagactggatacaaaaggcggaggcggaagtggaggcggaggatctggcggcggaggctctagggcacacctggtgcagtctggcaccgccatgaagaaacctggcgcttccgtcagagtgtcctgtcagacaagcggctacaccttcacagcccacatcctgttctggttcagacaggccccaggcagaggactggaatgggtcggatggatcaagccccagtacggggccgtgaatttcggcggaggcttcagagacagagtgaccctgaccagggacgtgtaccgggaaatcgcctacatggacatccggggcctgaagcctgatgacaccgccgtgtactactgcgccagggatagaagctacggcgacagctcttgggctctcgatgcttggggacagggcacaacagtggtggtgtctgctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3564 - DNA, 1746 bp, Artificial Sequence
  Synthetic Polynucleotide encoding a Bispecific antibody
atggccttaccagtgaccgccttgctcctgccgctggccttgctgctccacgccgccaggccggacgtgcagatgatccagacccccgatagcctggccgtgtccctgggacagagagccaccatctcttgcagagccagcgagagcgtggacaactacggcatcagcttcatgcactggtatcagcagaagcccggccagagccccaagctgctgatctacagagcctccaacctggaaagcggcatccccgccagattttccggcagcggcagcagaaccgacttcaccctgaccatcaaccccgtggaaaccgacgacgtggcaacctactactgccagcagaacaacaaggacccccccacctttggcggaggcaccaagctggaaatcaagggcggaggcggaagtggaggcggaggatctggcggcggaggctctgggggaggcggctctcaggtgcaactccagcagtctggcgctgagcttgtgaagcctggggccagcgtgaagattagctgcaaggccagcggctacgccttcagcagctactggatgaactgggtcaagcagcggcctggcaagggcctggaatggatcggccaaatctaccccggcgacggcgacaccacctacaacggcaagttcaagggcaaggccaccctgacagccgacaagagcagcagcaccgtgtacatgcaactgaacagcctgaccagcgaggacagcgccgtgtacttctgcgtgcggtactactacggcagctccggctacttcgactattggggccagggcaccacactgaccgtgtcctctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3565 - DNA, 1719 bp, Artificial Sequence
  Synthetic Polynucleotide encoding a Bispecific antibody
atggccttaccagtgaccgccttgctcctgccgctggccttgctgctccacgccgccaggccggacgtgcagatgatccagacccccagcagcctgtctgccagcctgggcgatagagtgaccatcagctgtcgggccagccaggacatcggcaactacctgaactggtatcagcagaaacccgacggcaccgtgaagctgctgatctactacaccagcagactgcacagcggcgtgcccagcagattttctggcagcggctctggcaccgagtacagcctgaccatctccaacctggaacaggaagatattgctacctacttctgtcagcaaggcagcgccctgccccctacatttggcggcggaacaaagctggaaatcaacggcggaggcggaagtggaggcggaggatctggcggcggaggctctgctctccagctccagcagtctggcgcagaactcgtgcggcctggcgcttctgtgaccctgagctgtaaagccagcggctacaccttcaccgactacgagatgcactgggtcaagcagacccctgtgcacggcctggaatggatcggagccatcgaccctgagacaggcggcaccgcctacaaccagaagttcgagggcaaggccatcctgaccgccgacaagagcagcagcacagcctacatggaactgcggagcctgacctccgaggacagccccgtgtactactgtgccagacggcggtactacggcagcagctccttcgactattggggccagggcaccaccctgaccgtgtctagtacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3566 - DNA, 1740 bp, Artificial Sequence
  Synthetic Polynucleotide encoding a Bispecific antibody
atgaggctccctgctcagctcctggggctgctaatgctctgggtctctggaagcagtggggatgttgtgatgactcagtctccactctccctgcccgtcacccctggagcgccggcctccatctcctgcagatccagtcagagcattgtacatagtaatggaaacacctatttagagtggtatcttcaaaagccagggcagtctccaaagctcctgatctataaagtttccaaccgattttctggagtccctgacaggttcagtggaagtggatcaggcacagattttacactgagaatcagcagagtggaggctgaggatgttggaatttattactgctttcaaggttcacatgttcctccgacgttcggccctgggaccaaattggaaatcaaaggcggaggcggaagtggaggcggaggatctggcggcggaggctctgaagtgcagctggtggagtctgggggaggcttggtccagcctggggggtccctgagactctcctgttcagcctctggattcacctttagtagctttggaatgcactgggtccgccaggctccagggaaggggctggaatgggtggcctacattagtagtggcagtagtaccatctactatggagacaccgtgaagggccgattcaccatctccagagacaacgccaagaactcactgtttctgcaaatgagcagcctgagagccgaggacacggccgtgtattattgtgcgagagaggggggatattactacggaaggagttactatactatggactactggggccaagggaccacggtcaccgtctccacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3567 - DNA, 1815 bp, Artificial Sequence
  Synthetic Polynucleotide encoding a Bispecific antibody
atggccttaccagtgaccgccttgctcctgccgctggccttgctgctccacgccgccaggccggccagaaagagaacccagcccaccttcggcttcaccgtgaactggaagttcagcgagagcaccaccgtgttcaccggccagtgcttcatcgaccggaacggcaaagaggtgctgaaaaccatgtggctgctgcggagcagcgtgaacgacatcggcgacgactggaaggccaccagagtgggcatcaacatcttcacccggctgcggacacagaaagagggcggctctggcggaagcgccagaaagtgtagcctgaccggcaagtggaccaacgacctgggcagcaacatgaccatcggagccgtgaacagcagaggcgagtttaccggcacctacatcaccgccgtgaccgccaccagcaacgagatcaaagagagccccctgcacggcacccagaacaccatcaacaagagcggcggcagcacaacagtgtttacaggacagtgctttattgaccgcaatgggaaagaagtgctgaaaacaatgtggctgctgaggtcctccgtgaatgacattggagatgattggaaagctacaagagtggggattaacatttttaccagactgaggacccagaaagaagggggcagcggaggctccgccagaaaatgctctctgacagggaagtggacaaatgatctggggtccaatatgacaatcggcgctgtgaactctcggggcgagttcactggaacatatattacagccgtgacagctacctctaacgaaatcaaagagtctcctctgcacgggacacagaataccattaacaaacggacccagcctacatttgggtttacagtgaattggaaattctccgagacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3568 - DNA, 1731 bp, Artificial Sequence
  Synthetic Polynucleotide encoding a Bispecific antibody
atggccttaccagtgaccgccttgctcctgccgctggccttgctgctccacgccgccaggccggacatcgtcctgacccagtccccagccagcctggcggtgtccctgggtcaacgagctaccatttcctgcagagcctctaagtccgtatccacttccggctatagttacctgcattggtaccaacagaaaccagggcagccacccaagctgctcatctatctggcctcaaacctggagtccggcgtgcccgccagattctccggaagtgggagcggcaccgactttacattgaacatccacccagtcgaagaggaagatgctgccacttattactgtcagcactccagggagctgccatttacatttggctctggcacaaaactggagatcaaaggcggaggcggaagtggaggcggaggatctggcggcggaggctctcaggttcagctggtcgagtccgggggaggtctggtacagccgggtggcagcctcaagctgtcatgtgccgcatctggttttgactttagcaggtattggatgagctgggtccgccaggccccgggcaagggacttgagtggattggagaaataaaccctacttccagcacaatcaacttcacaccttctttgaaagataaggtttttatctctcgggataacgctaaaaacacactgtacttgcagatgtctaaggtgcgaagcgaagacaccgccctctattattgcgcccggggtaattactaccgctatggggatgcgatggactattgggggcaaggtacctccgtcacggtctcaacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3569 - DNA, 1725 bp, Artificial Sequence
  Synthetic Polynucleotide encoding a Bispecific antibody
atggccttaccagtgaccgccttgctcctgccgctggccttgctgctccacgccgccaggccggacatccagatgacccagagccctagctcactgagcgccagcgtgggcgacagggtgaccattacctgctccgccagccaggacatcagcaactacctgaactggtaccagcagaagcccggcaaggcccccaagctgctgatctactacacctccaacctgcactccggcgtgcccagcaggttcagcggaagcggcagcggcaccgatttcaccctgaccatctccagcctgcagcccgaggacttcgccacctactactgccagcagtacaggaagctcccctggactttcggccagggcaccaaactggagatcaagcgtggcggaggcggaagtggaggcggaggatctggcggcggaggctctcaggtgcagctggtccagagcggcgccgaagtgaagaagcccggcagctccgtgaaagtgagctgcaaggccagcggcggcaccttcagcaactactggatgcactgggtgaggcaggcccccggacagggcctggagtggatgggcgccacctacaggggccacagcgacacctactacaaccagaagttcaagggccgggtgaccatcaccgccgacaagagcaccagcaccgcctacatggaactgagcagcctcaggagcgaggacaccgctgtgtattactgcgccaggggcgccatctacgacggctacgacgtgctggacaactggggccagggcacactggtgaccgtgtccagcacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3570 - DNA, 1725 bp, Artificial Sequence
  Synthetic Polynucleotide encoding a Bispecific antibody
atggccttaccagtgaccgccttgctcctgccgctggccttgctgctccacgccgccaggccggacatcgtgctgacacagagccctgccaccctgtctctgagccctggcgatagagccaccatcagctgtagagccagcgagagcgtgaccatcctgggcagccacctgatctactggtatcagcagaagcccggccagccccccagactgctgattcagctggcctccaatgtgcagaccggcgtgccagccagattttccggcagcggcagcagaaccgacttcaccctgaccatcagcagcgtggaacccgaggacttcgccgtgtactactgcctccagagccggaccatccccagaacattcggccagggcaccaagctggaaatcaagagaggcggaggcggaagtggaggcggaggatctggcggcggaggctctcaggtgcagctggtgcagtctggccccgaagtgaagaaacccggcgagtccgtgaagatcagctgcaaggccagcggctacaccttccggcactacagcatgaactgggtcaagcaggccccaggccagggcctgaagtggatgggcagaatcaacaccgagagcggcgtgcccatctacgccgacgacttcaagggccggttcagcttcaccgtggacaccagcgccagcaccgcctacctggaaatctccagcctgaccagcgaggataccgccgtgtatttctgctccaacgactacctgtacagcctggatttctggggccagggaaccaccctgacagtgtcctctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3571 - DNA, 1728 bp, Artificial Sequence
  Synthetic Polynucleotide encoding a Bispecific antibody
atggccttaccagtgaccgccttgctcctgccgctggccttgctgctccacgccgccaggccgcagtctgtgctgacacagcctcctagtgtgtctggcgctcctggacagagagtgaccatcagctgtacaggcagcagcagcaatatcggagccggctttgacgtgcactggtatcagcagctgcctggcacagcccctaaactgctgatctacggcaacagcaacagacccagcggcgtgcccgatagattttccggctctaagagcggcacaagcgccagcctggctattactggactccaggccgaggacgaggccgactactactgtcagagctacgacagcagcctgagcggctacgttttcggcaccggcaccaaagtgacagtgcttggtggcggaggcggaagtggaggcggaggatctggcggcggaggctctcaagttcagctggttcagagcggagccgaagtgaagaaacctggggcctctgtgaaggtgtcctgcaaggcttccggctacacctttaccgattactacatgcactgggtccgacaggctcccggccaaagacttgaatggatgggctggatcaaccccaacagcggcggcacaaattacgcccagaagttccaggaccggatcaccgtgaccagagacaccagctccaacaccggctacatggaactgacccggctgagatccgatgacaccgccgtgtactactgcgctagaagcccttactccggcgtgctggataagtggggacagggcacactggtcaccgtgtcatctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3572 - DNA, 1722 bp, Artificial Sequence
  Synthetic Polynucleotide encoding a Bispecific antibody
atggccttaccagtgaccgccttgctcctgccgctggccttgctgctccacgccgccaggccgcaggctgttctgacacagcctccatctgcctctggcacacctggacagagagtgaccatctcctgtagcggcagcagcagcaacatcggcagctacaccgtgtcctggtatcagcagctccctggaacagcccctaagttcctgatctacagcaacaaccagcggcctagcggcgtgcccgatagattttctggcagcaagagcggcacaagcgccagcctggctatttctggactccagtctgaggacgaggccgactactattgtgccgcctgggacgatagcctgaacggctatgtgtttggcaccggcaccaaagtgacagtgcttggtggcggaggcggaagtggaggcggaggatctggcggcggaggctctgaagttcaactggttcagagcggagccgaagtgaagaagcctggcgagagcctgaagattagctgcaaaggcagcggctacgacttcaccacctactggatcggctgggtccgacagatgcctggcaaaggactggaatggatgggcatcatctaccccggcgacagcgacaccagatacagccctagcgttagaggccgcgtgaccatcagcgccgacaagtctatcaacaccgcctacctccagtggtccagcctggaagcctctgacaccgccatgtactactgcgccagaatgtggaccttcagccaggatggatggggccagggaacactggtcacagtgtcatctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3573 - DNA, 1755 bp, Artificial Sequence
  Synthetic Polynucleotide encoding a Bispecific antibody
atggccttaccagtgaccgccttgctcctgccgctggccttgctgctccacgccgccaggccgctgcctgttctgacacagcctccatctgcctctggcacacctggacagagagtgaccatcagctgtagcggcagaagcagcaacatcggcagcaacagcgtgaactggtacagacagcttcctggcgctgcccctaagctgctgatctacagcaacaaccagcggcctcctggcgtgccagtcagattttctggcagcaagagcggcacaagcgccagcctggctatttctggactccagtctgaggacgaggccacctactactgtgccacctgggacgacaacctgaacgtgcactacgtgttcggcaccggcaccaaagtgacagtgcttggaagtagaggcggaggcggaagtggaggcggaggatctggcggcggaggctctcttgaaatggctcaggtgcagctggtgcagagcggagccgaagtgaagaaacctggcagcagcgtgaaggtgtcctgcaaagcttctggcggcaccttcagcagctacgccatctcttgggttcgacaggcccctggacaaggactggaatggatgggcagaatcatccccatcctgggaatcgccaactacgcccagaaattccagggcagagtgacaatcaccgccgacaagagcaccagcaccgcctacatggaactgagcagcctgagaagcgaggacaccgccgtgtactattgtgcaagaggcggctactacagccacgacatgtggagcgaagattggggccagggcacactggtcacagtgtcatctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3574 - DNA, 1722 bp, Artificial Sequence
  Synthetic Polynucleotide encoding a Bispecific antibody
atggccttaccagtgaccgccttgctcctgccgctggccttgctgctccacgccgccaggccggacatcgtgctgacacagagccctgcttctctggccgtgtctctgggagagagagccaccatcaactgtagagccagcgagagcgtgtccgtgattggagcccacctgatccactggtatcagcagaagcctggacagcctcctaagctgctgatctacctggcctccaacctggaaacaggcgtgccagccagattttctggcagcggctctggcaccgatttcaccctgacaatcagcagcctccaggccgaagatgccgccatctactactgcctccagagccggatcttccccagaacctttggacagggcaccaagctggaaatcaaaggcggaggcggaagtggaggcggaggatctggcggcggaggctctcaagttcagctggtgcagtctggctccgagctgaagaaacctggcgagtccgtgaagatcagctgcaaggccagcggctacaccttcaccgactacagcatcaactgggtcaagcaggcccctggacagggactgaaatggatgggctggatcaacaccgagacaagagagcccgcctacgcctacgacttcagaggcagattcgtgttctccctggacaccagcgccagcacagcctatctccagatcagctctctgaaggccgaggataccgccgtgtacttctgcgccctggactacagctacgctatggactattggggccagggcaccctggtcacagtctcttctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3575 - DNA, 1725 bp, Artificial Sequence
  Synthetic Polynucleotide encoding a Bispecific antibody
atggccttaccagtgaccgccttgctcctgccgctggccttgctgctccacgccgccaggccggacatcgtgctgacacagtctcccgccacactgtcactgagccctggcgatagagccacactgagctgtagagccagcgagagcgtgacaatcctgggcagccacctgatctactggtatcagcagaagcccggacaggcccctagactgctgattcagctcgccagcaatgtgcagacaggcatccctgccagattttccggcagcggcagcagaaccgatttcaccctgaccataagcagcctggaacctgaggacttcgccgtgtactactgcctccagagccggacaatccccagaacctttggacagggcaccaagctggaaatcaagagaggcggaggcggaagtggaggcggaggatctggcggcggaggctctcaagttcaactggtgcagagcggctccgagctgaagaaacctggcgagtccgtgaagattagctgcaaggccagcggctacaccttcacacactacagcatgaactgggtccgacaggctccaggccaaggactggaatggatgggcagaatcaacaccgagacaggcgagcccctgtacgccgacgatttcaagggcagattcgtgttcagcctggacaccagcgccagcacagcctatctccagatcagctctctgaaggccgaggacaccgccgtgtattattgcagcaacgactacctgtactccctggactattggggccagggcacactggtcacagtgtctagtacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3576 - DNA, 1728 bp, Artificial Sequence
  Synthetic Polynucleotide encoding a Bispecific antibody
atggccttaccagtgaccgccttgctcctgccgctggccttgctgctccacgccgccaggccggacatcgtgatgacccagagccccgatagcctggccgtgtctctgggagagagagccaccatcaactgcaagagcagccagagcatcctgtacagcagcaaccagaagaactacctggcctggtatcagcagaagcccggccagagccctaagctgctgatctactgggccagcaccagagaaagcggcgtgcccgatagattcagcggcagcggctctggcaccgacttcaccctgaccatcagttctcttcaggccgaggacgtggccgtgtactactgccaccagtacatcagctcctacaccttcggccagggcaccaagctggaaatcaagggcggaggcggaagtggaggcggaggatctggcggcggaggctctcaggtgcagctggtgcagtctggcgctgaagtgaagaaacctggggccagcgtgaaggtgtcctgcaaggccagcggctacacctttgccagccagtggatgcactggatgagacaggcccctggacagggcctggaatggatcggctggatcaaccccggcaacgtgaacaccaagtacaacgagaagttcaagggcagagccaccctgacagtggacaccagcaccaacaccgcctacatggaactgagcagcctgcggagcgaggacaccgccgtgtattattgcgccagaagcacctggtacagacccctggattattggggccagggaacccttgtgaccgtgtcctctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3577 - DNA, 2100 bp, Artificial Sequence
  Synthetic Polynucleotide encoding a Bispecific antibody
atggttaggggcgttccattcagacatctgcttctggtcttgcagcttgcactcttgcccgctgccacccagggcaaaaaagtggtgctgggcaagaaaggcgacaccgtggaactgacctgcaccgccagccagaagaagtccatccagttccactggaagaacagcaaccagatcaagatcctgggcaaccagggcagcttcctgaccaagggacccagcaagctgaacgacagagccgacagcagacggtccctgtgggaccagggcaatttcccactgattatcaagaacctgaagatcgaggacagcgacacctacatctgcgaggtggaagatcagaaagaagaggtgcaactgctggtgttcggcctgaccgccaactccgacacccatctgctccagggccagagcctgaccctgacactggaaagccctccaggcagctcccccagcgtgcagtgtagaagcccacgaggcaagaacatccagggaggcaaaacattgtcagtgtcccaactggaactccaggactccggcacctggacctgtaccgtgctccagaaccagaaaaaggtggagttcaagatcgacatcgtggtgctggccttccagaaagcctctggcggaggcggaagtggaggcggaggatctggcggcggaggctctatctaccaggaactgacacaactgaaggccgccgtggaacggctgtgccacccttgtccttgggagtggaccttctttcagggcaactgctacttcatgagcaacagccagcggaactggcacgacagcatcaccgcctgcaaagaagtgggagcccaactggtcgtgattaagagcgccgaggaacagaacttcctccaactccagagcagcagaagcaacagattcacctggatgggcctgagcgacctgaaccaggaaggcacctggcagtgggtggacggatctcctctgctgcccagcttcaagcagtattggaaccggggcgagcccaacaacgtgggcgaagaggattgcgccgagttcagcggcaacggctggaacgacgacaagtgcaacctggctaagttctggatctgcaagaagtccgccgcctcctgtagccgggatgaggaacagttcctgagccctgcccctgccacccctaatcctccaccagctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3578 - DNA, 1728 bp, Artificial Sequence
  Synthetic Polynucleotide encoding a Bispecific antibody
atggccttaccagtgaccgccttgctcctgccgctggccttgctgctccacgccgccaggccggaccacatcgtgctgacccagagccctagcagcctgtctgccagcctgggcgacagagtgaccatcagctgtagagccagccaggacatcagcacctacctgaactggtatcagcagaaacccgacggcaccgtgaagctgctgatcttctacaccagcagactgcacgccggggtgcccagcagattttctggcagcggctctggcacccaccacagcctgaccatctccaacctggaacaggaagatattgctacctacttctgtcagcaaggcaacagcctgcccttcaccttcggcagcggcaccaagctggaaatcaagagaggcggaggcggaagtggaggcggaggatctggcggcggaggctctcaggtgcagctgaaagagagcggccctgagctggaaaagcctggggccagcgtgaagattagctgcaaggccagcggctacagcttcaccgcctacagcatgaactgggtcaagcagaacaacggcatgagcctggaatggatcggcagcatcgacccctactacggcgacaccaaatacgcccagaagttcaagggcaaggccaccctgaccgtggataaggccagcagcaccgcctacctccagctgaagtctctgaccagcgaggacagcgccgtgtactactgcgccagacggatgattaccaccggcgactggtacttcgacgtgtggggagccggaaccaccgtgacagtgtctagcacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3579 - DNA, 1728 bp, Artificial Sequence; identical to SEQ ID NO: 3578
  Synthetic Polynucleotide encoding a Bispecific antibody

SEQ ID NO: 3580 - DNA, 1569 bp, Artificial Sequence
  Synthetic Polynucleotide encoding a Bispecific antibody
atggcccttccagtcactgccttgctgttgcctctggcgctcctgctccacgccgctagaccgggcatgagaaccgaggacctgcctaaggccgtggtgttcctggaaccccagtggtacagagtgctggaaaaggacagcgtgaccctgaagtgccagggcgcctacagccccgaggacaatagcacccagtggttccacaacgagagcctgatctccagccaggccagcagctacttcatcgacgccgccaccgtggacgacagcggcgagtatagatgccagaccaacctgagcaccctgagcgaccccgtgcagctggaagtgcacatcggatggctgctgctgcaggcccccagatgggtgttcaaagaagaggaccccatccacctgagatgccactcttggaagaacaccgccctgcacaaagtgacctacctgcagaacggcaagggcagaaagtacttccaccacaacagcgacttctacatccccaaggccaccctgaaggactccggctcctacttctgcagaggcctcgtgggcagcaagaacgtgtccagcgagacagtgaacatcaccatcacccagggcctggccgtgtctaccatcagcagctttttcccacccggctaccagacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3581 - DNA, 1569 bp, Artificial Sequence
  Synthetic Polynucleotide encoding a Bispecific antibody
atggccttaccagtgaccgccttgctcctgccgctggccttgctgctccacgccgccaggccgggcatgcggactgaagacctcccaaaggctgtggtgttcctggagcctcaatggtacagggtgctggagaaggacagtgtgactctgaagtgccagggagcctactcccctgaggacaattccacacagtggtttcacaatgagagcctcatctcaagccaggcctccagctacttcattgacgctgccacagtggacgacagtggagagtacaggtgccagacaaacctctccaccctcagtgacccggtgcagctagaagtccatatcggctggctgttgctccaggcccctcggtgggtgttcaaggaggaagaccctattcacctgaggtgtcacagctggaagaacactgctctgcataaggtcacatatttacagaatggcaaaggcaggaagtattttcatcataattctgacttctacattccaaaagccacactcaaagacagcggctcctacttctgcagggggcttgttgggagtaaaaatgtgtcttcagagactgtgaacatcaccatcactcaaggtttggcagtgtcaaccatctcatcattctttccacctggctaccaaacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3582 - DNA, 1728 bp, Artificial Sequence
  Synthetic Polynucleotide encoding a Bispecific antibody
atggccttaccagtgaccgccttgctcctgccgctggccttgctgctccacgccgccaggccggacgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagcggagcaactggcccatcacattcggccagggcacccggctggaaatcaaaggcggaggcggaagtggaggcggaggatctggcggcggaggctctgaagtgcagctggtggaatcaggcggcggactggtgcagcctggcagaagcctgagactgagctgtgccgccagcggcttcaccttcaacgactacgccatgcactgggtgcgccaggcccctggaaaaggactggaatgggtgtccacaatcagctggaacagcggcagcatcggctacgccgatagcgtgaagggccggttcaccatcagccgggacaacgccaagaagtccctgtacctccagatgaacagcctgcgggccgaggacacagccctgtactattgcgccaaggacatccagtacggcaactactactacggcatggacgtgtggggccagggaaccaccgtgaccgtgtcatctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3583 - DNA, 1734 bp, Artificial Sequence
  Synthetic Polynucleotide encoding a Bispecific antibody
atggccttaccagtgaccgccttgctcctgccgctggccttgctgctccacgccgccaggccggacatcgtgatgacccagacccccctgagcctgcctgtgacacctggcgagcctgccagcatctcctgcagaagcagcaagagcctgctgcacagcaacggcatcacctacctgtactggtatctgcagaaacccggccagagcccccaactgctgatctaccagatgagcaacctggtgtccggcgtgcccgacagattttctggcagcggctccggcaccgacttcaccctgaagatcagccgggtggaagccgaggacgtgggcgtgtactactgcgcccagaacctggaactgccctacacctttggcggcggaacaaaggtggaaatcaagcggggcggaggcggaagtggaggcggaggatctggcggcggaggctctcaggtgcaactggtgcagagcggagccgaagtgaaaaagcccggcagcagcgtgaaggtgtcctgcaaggccagcggctacgccttcagctactcctggatcaactgggtgcgccaggcccctggacagggcctggaatggatgggcagaatcttccccggcgacggcgacaccgactacaacggcaagttcaagggcagagtgaccatcaccgccgacaagagcaccagcaccgcctacatggaactgagcagcctgcggagcgaggataccgccgtgtactattgtgccagaaacgtgttcgacggctactggctggtgtactggggccagggaacacttgtgaccgtgtccagcacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3584 - DNA, 1725 bp, Artificial Sequence
  Synthetic Polynucleotide encoding a Bispecific antibody
atggccttaccagtgaccgccttgctcctgccgctggccttgctgctccacgccgccaggccggacatcgtgctgacacagagccctgccatcatcacagcctctccaggcgagaaagtgaccatgacctgtagagccagcagcagcgtgaactacatggactggtatcagaagaagcccggcagcagccccaagccttggatctacgccacaagcaatctggcctctggcgtgcccagcagattttctggctctggcagcggcaccacctacagcatgacaatctctagcctggaagccgaggacgccgccacctactattgtcagcagtggtccttcaatcctcctaccttcggcggaggcaccaagctggaaatcaaaagaggcggaggcggaagtggaggcggaggatctggcggcggaggctctgaagttcagcttcagcagagcggagccgagctgaagaaacctggcgcttctgtgaaggtgtcctgcaaggccagcggctacacctttaccagctacaacatgcactgggtcaagcagaccccaggccagggactcgaatggatcggagccatctatcccggcaacggcgacacctcctacaaccagaagttcaagggcaagaccacactgaccgccgacaagagcagctccaccgcctacatggaactgagcagcctgagatccgaggataccgccgtgtactactgcgccagaagcaactactacggcagctcctactggttcttcgacgtgtggggcaccggcacaaccgtgacagtttcttctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3585 - DNA, 1734 bp, Artificial Sequence
  Synthetic Polynucleotide encoding a Bispecific antibody
atggccttaccagtgaccgccttgctcctgccgctggccttgctgctccacgccgccaggccggagatcgtgctgacacagtctcccgccacactgtcactgtctccaggcgaaagagccacactgagctgtagagccagccagagcgtgtcctcttacctggcctggtatcagcagaagcctggacaggctccccggctgctgatctacgatgccagcaatagagccacaggcatccccgccagattttctggctctggcagcggcaccgatttcaccctgaccataagcagcctggaacctgaggacttcgccgtgtactactgccagcagagaagcgactggcccctgacatttggcggcggaacaaaggtggaaatcaaaggcggaggcggaagtggaggcggaggatctggcggcggaggctctgaagtgcaactggttcaatcaggtggcggcctggttcaccctggcggatctctgagactgtcttgtaccggcagcggcttcaccttcagctaccacgccatgcactgggtccgacaggcacctggaaaaggactggaatgggtgtccatcatcggcacaggcggcgtgacctactacgccgattctgtgaagggcagattcaccatcagccgggacaacgtgaagaacagcctgtacctccagatgaactccctgagagccgaggatatggccgtgtattattgcgccagagactactacggcgctggcagcttttacgacggcctgtacggaatggatgtgtggggccagggaaccaccgtgactgtctcttctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3586 - DNA, 1728 bp, Artificial Sequence
  Synthetic Polynucleotide encoding a Bispecific antibody
atggccttaccagtgaccgccttgctcctgccgctggccttgctgctccacgccgccaggccggagatcgtgctgacacagtctcccgccacactgtcactgtctccaggcgaaagagccacactgagctgtagagccagccagagcgtgtcctcttacctggcctggtatcagcagaagcctggacaggctccccggctgctgatctacgatgccagcaatagagccacaggcatccccgccagattttctggctctggcagcggcaccgatttcaccctgaccataagcagcctggaacctgaggacttcgccgtgtactactgccagcagagaagcaactggcccctgacatttggcggaggcaccaaggtggaaatcaaaggcggaggcggaagtggaggcggaggatctggcggcggaggctctgctgtgcagctcgttgagtctggcggaggacttgttcagcctggcagatccctgagactgtcttgtgccgccagcggcttcaccttcggcgattacacaatgcactgggtccgacaggcccctggcaaaggacttgaatgggtgtccggcatctcctggaacagcggctctatcggctacgccgattccgtgaagggcagattcaccatcagccgggacaacgccaagaacagcctgtacctccagatgaactccctgagagccgaggacacagccctgtactattgcaccaaggacaaccagtacggctccggcagcacatacggacttggagtttggggccagggcaccctggttacagtctcttctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3587 - DNA, 1725 bp, Artificial Sequence
  Synthetic Polynucleotide encoding a Bispecific antibody
atggccttaccagtgaccgccttgctcctgccgctggccttgctgctccacgccgccaggccggacatccagatgacacagagccctagcagcctgtctgccagcgtgggagacagagtgaccatcacctgtagagccagcagcagcgtgtcctacatgcactggtatcagcagaagcccggcaaggcccctaagcctctgatctacgcccctagcaatctggcctctggcgtgccaagcagattttctggcagcggctctggcaccgacttcaccctgacaatatccagcctccagcctgaggacttcgccacctactactgccagcagtggtccttcaatcctcctaccttcggccagggcaccaaggtggaaatcaaaagaggcggaggcggaagtggaggcggaggatctggcggcggaggctctgaagtgcagcttgttgaatctggcggcggactggttcagcctggcggatctctgagactgtcttgtgccgccagcggctacaccttcaccagctacaatatgcactgggtccgacaggcccctggcaaaggacttgaatgggtcggagccatctatcccggcaacggcgacacctcctacaaccagaagttcaagggcagattcaccatcagcgtggacaagagcaagaacaccctgtacctccagatgaactccctgagagccgaggacaccgccgtgtactattgtgccagagtggtgtactacagcaacagctactggtacttcgacgtgtggggccagggaaccctggtcacagtttcttctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3588 - DNA, 1719 bp, Artificial Sequence
  Synthetic Polynucleotide encoding a Bispecific antibody
atggccttaccagtgaccgccttgctcctgccgctggccttgctgctccacgccgccaggccggacatccagctcacacagagcccttctagcctgtctgccagcgtgggcgatagagtgaccatgacctgtagagccagcagcagcgtgtcctacatccactggttccagcagaagcctggcaaggcccctaagccttggatctacgccaccagcaatctggcctctggcgtgccagtcagattttctggcagcggctctggcaccgactacaccttcacaatatccagcctccagcctgaggacattgccacctactactgccagcagtggacctccaatcctcctacctttggcggaggcaccaagctggaaatcaaaggcggaggcggaagtggaggcggaggatctggcggcggaggctctcaggttcagctccagcagtctggggccgaagtgaagaaacctggcagctccgtgaaagtgtcctgcaaggccagcggctacacctttaccagctacaacatgcactgggtcaagcaggcccctggacagggactcgaatggatcggagccatctatcccggcaacggcgacacctcctacaaccagaagttcaagggcaaagccacactgaccgccgacgagagcacaaacaccgcctacatggaactgagcagcctgagaagcgaggacaccgccttctactactgtgcccggtctacctactacggcggcgactggtactttgacgtgtggggccagggaaccaccgtgacagtttcttctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3589 - DNA, 1755 bp, Artificial Sequence
  Synthetic Polynucleotide encoding a Bispecific antibody
atggccttaccagtgaccgccttgctcctgccgctggccttgctgctccacgccgccaggccgagcaccgtgatgacacagagccctgatagcctggccgtgtctctgggagagagagccaccatcaactgcaagagcagccagagcaacagcaacgacgtggcctggtatcagcagaagccaggacagagccccaaggtgctgatctacttcgccagcaacagatacagcggcgtgcccgatagattttccggcagcggctacggcaccgacttcacccttacaatcagcagcctccaggccgaggatgtggccgtgtacttctgtcagcaagactacagcagccctctgacctttggagccggcaccaagctggaactgaaaagagctgacgctggcggaggcggaagtggaggcggaggatctggcggcggaggctctcagattcagctggtgcagtctggcagcgagctgaagaaacctggggcctctgtgaaggtgtcctgcaaggcttccggctacacctttaccaacttcggcgtgaactgggtccgacaggcccctggaaaaggactggaatggatgggctggatcaacacctacaccggcgagcctagctacgcccagggctttacaggcagattcgtgttcagcctggacgcctctgtgtctaccgcctacctccagatcagctccctgaaagccgaggacaccgccacctatttctgcaccagacggaccaactactacgggacctcctactactacgctatggactactggggccagggcaccaccgtgacagtgtctagcgccaagacaaccacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3590 - DNA, 1731 bp, Artificial Sequence
  Synthetic Polynucleotide encoding a Bispecific antibody
atggccttaccagtgaccgccttgctcctgccgctggccttgctgctccacgccgccaggccgcagatcgtgctgtctcagtctcctgccatcctgagcgcttccccaggcgagaaagtgaccatgacctgtagagccagcagcagcgtgtcctacatgcactggtatcagcagaagcccggcagcagccctaagccttggatctacgccaccagcaatctggcctctggcgtgccagccagattttctggctctggcagcggcaccagctacagcttcacaatcagcagagtggaagccgaggacgccgccacctactattgtcagcagtggaccttcaatcctcctaccttcggcggaggcacccggctggaaatcaaaagaacagtggctgctggcggaggcggaagtggaggcggaggatctggcggcggaggctctcaggcttatctgcaacagagcggagccgaactcgtcagacctggcgcttctgtgaagatgagctgcaaggccagcggctacaccttcaccagctataatatgcactgggtcaagcagacccctcggcagggactcgaatggatcggcggaatctatcccggcaacggcgacacctcctacaaccagaagttcaagggcaaagccacactgaccgtgggcaagagcagcagcaccgcctatatgcagctcagcagcctgaccagcgaggacagcgccgtgtacttctgcgccagatacgactacaactacgctatggactactggggccagggcaccagcgtgacagttagctctgccagcacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3591 - DNA, 1725 bp, Artificial Sequence; identical to SEQ ID NO: 3587
  Synthetic Polynucleotide encoding a Bispecific antibody

SEQ ID NO: 3592 - DNA, 1722 bp, Artificial Sequence
  Synthetic Polynucleotide encoding a Bispecific antibody
atggccttaccagtgaccgccttgctcctgccgctggccttgctgctccacgccgccaggccggagatcgtgctgacacagagcccttctagcctgtctgccagcgtgggcgacagagtgaccatcacatgtagagccagcagcagcctgagcttcatgcactggtatcagcagaagcccggcaaggcccctaagccttggatctacgccaccagcaatctggcctctggcgtgccaagcagattttctggcagcggctctggcaccgactacaccctgacaatatccagcctccagcctgaggacttcgccacctacttttgccaccagtggtccagcaatcctctgacctttggcggaggcaccaaggtggaaatcaaaggcggaggcggaagtggaggcggaggatctggcggcggaggctctcaggtgcaactggtgcagtctggggccgaagtgaagaaacctggggcctctgtgaaggtgtcctgcaaggcttccggctacacctttaccagctacaatatgcactgggtccgacaggctcccggccagagacttgaatggatcggagccatctatcccggcaacggcgacacctcctacaaccagaaattcaagggccgcgtgaccgtgaccagagacacatctgccaacaccgcctacatggaactgtctagcctgaagtccgaggacaccgccgtgtactactgtgccagaagccactacggcagcaactacgtggactacttcgactactggggccagggcacactggtcacagtctcttctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3593 - DNA, 1728 bp, Artificial Sequence
  Synthetic Polynucleotide encoding a Bispecific antibody
atggccttaccagtgaccgccttgctcctgccgctggccttgctgctccacgccgccaggccggacgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagcggagcaactggcccatcacattcggccagggcacccggctggaaatcaaaggcggaggcggaagtggaggcggaggatctggcggcggaggctctgaggtgcagcttgttgagtctggcggaggactggtgcagcccgatagaagcctgagactgtcttgtgccgccagcggcttcaccttccacgattatgccatgcactgggtccgacaggcccctggcaaaggacttgaatgggtgtccaccatctcttggaacagcggcacaatcggctacgccgactctgtgaagggcagattcaccatcagccgggacaacgccaagaacagcctgtacctccagatgaactccctgagagccgaggacacagccctgtactactgcgccaaggacatccagtacggcaactactactacggcatggacgtgtggggccagggcacaacagtgacagtctcttctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3594 - DNA, 1722 bp, Artificial Sequence
  Synthetic Polynucleotide encoding a Bispecific antibody
atggccttaccagtgaccgccttgctcctgccgctggccttgctgctccacgccgccaggccggagatcgtgctgacacagagccctggcacactgtcactgtctccaggcgaaagagccacactgagctgtagagccagcagcagcgtgccctacatccactggtatcagcagaagcctggacaggcccctcggctgctgatctatgccacatctgctctggcctctggcatccccgatagattttctggcagcggctccggcaccgacttcaccctgacaatcagcagactggaacccgaggacttcgccgtgtactactgtcagcagtggctgagcaaccctcctacattcggccagggcaccaagctggaactgaaaagaggcggaggcggaagtggaggcggaggatctggcggcggaggctctgaagttcagctggttcagagcggagccgaagtgaagaagccaggcgagagcctgaagctgagctgcaaaggcagcggcagaaccttcaccagctacaacatgcactgggtccgacagatgcccggcaaaggactggaatggatgggcgctatctaccctctgaccggcgacacctcctacaaccagaaaagcaagctgcaagtgaccatcagcgccgacaagagcatcagcacagcctacctccagtggtcctctctgaaggccagcgacaccgccatgtactattgtgccagaagcacctacgtcggcggcgactggcagtttgatgtgtggggcaagggcaccaccgtgaccgtttcttctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3595 - DNA, 1737 bp, Artificial Sequence
  Synthetic Polynucleotide encoding a Bispecific antibody
atggccttaccagtgaccgccttgctcctgccgctggccttgctgctccacgccgccaggccggacatccagatgacccagagccccagcagcctgtctgccagcgtgggcgacagagtgaccatcacctgtcggagcagccagagcatcgtgcactccgtgggcaacaccttcctggaatggtatcagcagaagcccggcaaggcccccaagctgctgatctacaaggtgtccaacagattcagcggcgtgcccagcaggtttagcggctctggcagcggcaccgacttcaccctgaccatctctagcctccagcccgaggacttcgccacctactactgttttcaaggcagccagttcccctacaccttcggccagggaacaaaggtggaaatcaagcggggcggaggcggaagtggaggcggaggatctggcggcggaggctctgaagtgcaactggtggaaagcggaggcggcctggtgcagcctggcggatctctgagactgagctgtgccgccagcggctacgagttcagccggtcctggatgaactgggtgcgccaggcccctggcaagggactggaatgggtgggaagaatctaccccggcgacggcgacaccaactacagcggcaagttcaagggccggttcaccatcagcgccgacaccagcaagaacaccgcctacctccagatgaacagcctgcgggccgaggataccgccgtgtactactgtgccagagatggcagctcctgggactggtacttcgacgtgtggggacagggaacccttgtgaccgtgtccagcacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3596 - DNA, 1713 bp, Artificial Sequence
  Synthetic Polynucleotide encoding a Bispecific antibody
atggccttaccagtgaccgccttgctcctgccgctggccttgctgctccacgccgccaggccggacatcgtgatgacccagagccccagcagcctgtctgccagcgtgggcgacagagtgaccatcacatgcaaggccagccagagcgtgaccaacgacgtggcctggtatcagcagaagcccggcaaggcccccaagctgctgatctactacgccagcaacagatacaccggcgtgcccagcagattcagcggctctggcagcggcaccgacttcaccctgaccatctctagcctccagcccgaggacttcgccacctactactgtcagcaggactacagaagcccctggaccttcggcggaggcaccaaggtggaaatcaagcggggcggaggcggaagtggaggcggaggatctggcggcggaggctctcaggtgcaactggaagaaagcgggggaggcgtcgtgcggcctggaagaagtctgagactgagctgtgccgccagcggcttcaccttcagcgactacggcgtgaactggatcagacaggcccctggcaagggcctggaatgggtcacaatcatctggggcgacggcagaaccgactacaacagcgccctgaagtcccggttcaccgtgtcccggaacaacagcaacaacaccctgagcctccagatgaacagcctgaccaccgaggacaccgccgtgtactactgtgtgcgggctcccggcaaccgggctatggaatattggggacagggcgtactcgtgaccgtgtcctctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3597 - DNA, 1731 bp, Artificial Sequence
  Synthetic Polynucleotide encoding a Bispecific antibody
atggccttaccagtgaccgccttgctcctgccgctggccttgctgctccacgccgccaggccggacatccagatgacccagagccccagcagcctgtctgccagcgtgggcgacagagtgaccatcacctgtagagccagccagaccatctggtcctacctgaactggtatcagcagaggcccggcaaggcccccaacctgctgatctatgccgccagctctctccagagcggcgtgcccagcagattttccggcagaggcagcggcaccgacttcaccctgaccatcagttccttgcaggccgaggacttcgccacctactactgccagcagagctacagcatcccccagattttcggccagggcaccaagctggaaatcaagggcggaggcggaagtggaggcggaggatctggcggcggaggctctcaggtgcagctccagcagtctggacccggcctcgtgaagcctagccagacactgagcctgacctgcgccatcagcggcgatagcgtgtccagcaatagcgccgcctggaactggatcagacagtccccctctcggggcctggaatggctgggccggacctactaccgcagcaagtggtacaacgactacgccgtgtccgtgaagtcccggatcaccatcaaccccgacaccagcaagaaccagttctccttgcaactgaacagcgtgacccccgaggacaccgccgtgtactactgcgccagagaagtgaccggcgacctggaagatgccttcgacatctggggccagggaacaatggtcacagtgtccagcacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3598 - DNA, 1731 bp, Artificial Sequence
  Synthetic Polynucleotide encoding a Bispecific antibody
atggccttaccagtgaccgccttgctcctgccgctggccttgctgctccacgccgccaggccgcaggtgcagctccagcagtctggacccggcctcgtgaagcctagccagacactgagcctgacctgcgccatcagcggcgatagcgtgtccagcaatagcgccgcctggaactggatcagacagtccccctctcggggcctggaatggctgggccggacctactaccgcagcaagtggtacaacgactacgccgtgtccgtgaagtcccggatcaccatcaaccccgacaccagcaagaaccagttctccttgcaactgaacagcgtgacccccgaggacaccgccgtgtactactgcgccagagaagtgaccggcgacctggaagatgccttcgacatctggggccagggaacaatggtcacagtgtccagcggcggaggcggaagtggaggcggaggatctggcggcggaggctctgacatccagatgacccagagccccagcagcctgtctgccagcgtgggcgacagagtgaccatcacctgtagagccagccagaccatctggtcctacctgaactggtatcagcagaggcccggcaaggcccccaacctgctgatctatgccgccagctctctccagagcggcgtgcccagcagattttccggcagaggcagcggcaccgacttcaccctgaccatcagttccttgcaggccgaggacttcgccacctactactgccagcagagctacagcatcccccagattttcggccagggcaccaagctggaaatcaagacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3599 - DNA, 1710 bp, Artificial Sequence
  Synthetic Polynucleotide encoding a Bispecific antibody
atggccttaccagtgaccgccttgctcctgccgctggccttgctgctccacgccgccaggccggacatccagatgacccagagccccgccaccatcgagaacacaagcctgtctgccagcgtgggcgacagagtgaccatcacctgtagagccagccagggcatcagctcttggctgacctggtatcagcagaagcccgagaaggcccccaagagcctgatctacgccgccagctctctgcagtctggcgtgcccagcagattttccggcagcggctctggcaccgacttcaccctgacaatcagcagcctgcagcccgaggacttcgccacctactactgccagcagtacgacagctaccccatcaccttcggccagggcacccggctggaaatcaagggcggaggcggaagtggaggcggaggatctggcggcggaggctctcaggtgcaactgcagcagtggggagccggactgctgaagcctagcgagacactgagcctgacctgcgccgtgtacggcggcagcttcagcgcctactattggagctggatcagacagccccctggcaagggcctggaatggatcggcgacatcaatcacggcggaggcaccaactacaaccccagcctgaagtcccgcgtgaccatctccgtggacaccagcaagaaccagttctccctgaagctgaacagcgtgacagccgccgacacagccgtgtactactgtgccagcctgaccgcctattggggccagggatctcttgtgaccgtgtccagcacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3600 - DNA, 1725 bp, Artificial Sequence
  Synthetic Polynucleotide encoding a Bispecific antibody
atggccttaccagtgaccgccttgctcctgccgctggccttgctgctccacgccgccaggccggacgagatcgtgctgacccagagccctgatagcctggccgtgtctctgggcgagagagccaccatcaactgcaaggccagccagagcgtggacttcgacggcgacagctacctgaactggtatcagcagaagcccggccagccccccaaggtgctgatctatgccgccagcacactgcagagcggcgtgcccagcagattttctggcagcggctccggcaccgacttcaccctgaccatcaacagcctggaagccgaggacgccgccacctactactgccagcagagcaacgaggacccctggacctttggcggcggaacaaaggtggaaatcaagggcggaggcggaagtggaggcggaggatctggcggcggaggctctcaggtgcaactggtgcagtccggcgctgaagtgaagaaacctggggccagcgtgaaggtgtcctgcaaggtgtccggctacacctttaccgactactacattacctgggtgcgccaggcccctggacaggccctggaatggatgggctggatctaccccggcagcggcaacaccaagtacagccagaagttccagggcagattcgtgttcagcgtggacaccagcgccagcaccgcctacctgcaactgtctagcctgaaggccgaagataccgccgtgtactactgcgccaactacggcaactattggttcgcctattggggccagggaacccttgtgaccgtgtcctctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3601 - DNA, 1716 bp, Artificial Sequence
  Synthetic Polynucleotide encoding a Bispecific antibody
atggccttaccagtgaccgccttgctcctgccgctggccttgctgctccacgccgccaggccggacatccagatgacccagagccccagcagcctgtctgccagcgtgggcgacagagtgaccatcacctgtagagccagccagggcatcagctcttggctggcctggtatcagcagaagcccgagaaggcccccaagagcctgatctacgccgcctctagtctccagagcggcgtgcccagcagattttctggcagcggctccggcaccgacttcaccctgacaatcagctccctccagcccgaggacttcgccacctactactgccagcagtacaacagctaccctcccacctttggcggaggcaccaaggtggaaatcaagggcggaggcggaagtggaggcggaggatctggcggcggaggctctgaagtgcaactggtgcagtctggcggagggctggtgcatcctgggggaagcctgagactgagctgtgccggctctggcttcgccttcagcagcagcaccatgcactggatcagacaggcccctggcaagggcctggaatggatcagcctgatcggaagcggagggggcatctactacggcgacagcgtgaagggccggttcaccatcagccgggacaacgccaagaacagcctgtacctccagatgaactccctgcgggccgaggacatggccgtgtactattgtgtgcggggctacttcgactgggtggactacttcgattactggggccagggcaccctcgtgaccgtgtcatctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3602 - DNA, 1746 bp, Artificial Sequence
  Synthetic Polynucleotide encoding a Bispecific antibody
atggccttaccagtgaccgccttgctcctgccgctggccttgctgctccacgccgccaggccggacgacatcgtgatgacacagtcaccagatagcctcaccgtctccctgggggagcggaccaccattaattgtaaatccagccaaagcgtgctggactcaagcaagaacaagaatagcctcgcctggtatcagcagaagcccggtcagcctccaaagctgctgctttcttgggcctccaccagagagtccgggattcctgataggtttagtggttcaggctccggcacagattttactctgaccattgattctctccagccagaggattctgcaacttattactgccagcaaagcgcccactttcctataacttttggccagggaacccgacttgaaatcaagggcggaggcggaagtggaggcggaggatctggcggcggaggctctcaggtgcagctggtgcagagcggtgccgaagtgaagaaaccaggtgcatccgttaaagtttcatgtaaggctagtggatataccttcaccaattacggaatgaactgggtgaaacaggcccctggccagggactgaagtggatggggtggattaacacctacaccggggagccgacttatgcagacgactttaaggggcgggtcacgatgacctccgacacctccaccagtaccgcctacctggagctgcacaaccttaggtcagacgataccgccgtgtattactgtgcccgatggtcttggtccgacggatactatgtctacttcgactattggggccaggggaccacagttaccgtgtcctctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3603 - DNA, 1734 bp, Artificial Sequence
  Synthetic Polynucleotide encoding a Bispecific antibody
atggccttaccagtgaccgccttgctcctgccgctggccttgctgctccacgccgccaggccggacgagatcgtgctgacacagagccctggaagcctggccgtgtctcctggcgagcgcgtgacaatgagctgcaagagcagccagagcgtgttcttcagcagctcccagaagaactacctggcctggtatcagcagatccccggccagagccccagactgctgatctactgggccagcaccagagaaagcggcgtgcccgatagattcaccggcagcggctctggcaccgacttcaccctgacaatcagcagcgtgcagcccgaggacctggctatctactactgccaccagtacctgagcagccggaccttcggccagggcaccaagctggaaatcaagagaggcggaggcggaagtggaggcggaggatctggcggcggaggctctcaggtgcaactgcagcagcctggcgctgaggtcgtgaagccaggcgcttccgtgaagatgtcctgcaaggccagcggctacaccttcaccagctactacatccactggatcaagcagacccctggacagggcctggaatgggtgggagtgatctaccccggcaacgacgacatcagctacaaccagaagttccagggcaaggccaccctgaccgccgacaagtctagcaccaccgcctacatgcaactgtccagcctgaccagcgaggacagcgccgtgtactactgcgccagagaagtgcggctgcggtacttcgatgtgtggggccagggaaccaccgtgaccgtgtcatctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3604 - DNA, 1812 bp, Artificial Sequence
  Synthetic Polynucleotide encoding a Bispecific antibody
atggccttaccagtgaccgccttgctcctgccgctggccttgctgctccacgccgccaggccgtacatcaacatctacaacgccgagcctgccaatcctagcgagaagaacagccccacacagtacgcctacggcagcggagaattcgacatccagctgacacagagcccttctagcctgtctgccagcgtgggcgacagagtgaccatcacatgtagagccagccagggcatcagctctgtgctggcttggtatcagcagaagcctggcaaggcccctaagctgctgatctacgatgccagcagcctggaaagcggcgtgccaagcagattttctggcagcggctctggcaccgacttcaccctgacaatatccagcctccagcctgaggacttcgccacctactactgccagcagttcaacagcagcatcaccttcggccagggcaccaagctggaaatcaagagaacagtggcagccggcggaggcggaagtggaggcggaggatctggcggcggaggctctcaagttcagctggttcagtctggggccgaagtgaagaaacctggcagcagcgtgaaggtgtcctgcaaagcaagcggcggcaccttcagcgattacgccatctcttgggtccgacaggcccctggacaaggactggaatggatgggcagaatcatccccatcctgggcgtcgccaattacgcccagaaattccagggccgcgtgacaatcaccgccgacaagtctaccagaaccgcctacatggaactgagcagcctgagaagcgaggacaccgccgtgtactactgcgccagaaattgggccgacgccttcgacatttggggccagggaacaatggtcaccgtgtctagcgcctccacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3605 - DNA, 1809 bp, Artificial Sequence
  Synthetic Polynucleotide encoding a Bispecific antibody
atggccttaccagtgaccgccttgctcctgccgctggccttgctgctccacgccgccaggccgtacatcaacatctacaacgccgagcctgccaatcctagcgagaagaacagccccacacagtacgcctacggcagcggagaattcgacatcgtgatgacacagagccctagcagcctgtctgcctctctcggcggcaaagtgaccatcacatgcaaggccagccaggacatcaacaagtatatcgcctggtatcagcacaagcccggcaagggacctagactgctgatccactacaccagcacactccagcctggcatccccagcagattttctggcagcggctccggcagagactacagcttcagcatcagcaacctggaacctgaggacattgccacctactactgcctccagtacgacaacctgctgacctttggagccggcaccaagctggaactgaaaagaggcggaggcggaagtggaggcggaggatctggcggcggaggctctgaagtgaaactccagcagagcggccctgagctggttaagcctggcaccagcgtgaaggtgtcctgtaaagccagcggctactccttcaccgactacaacatgtactgggtcaagcagagccacggcaagagcctggaatggatcggctacatcgacccctacaaaggcggcaccatctacaaccagaagttcaagggcaaagccacactgaccgtggacaagagcagcagcaccgccttcatgcacctgaacagcctgaccagcgaggacagcgccgtgtactattgcgccagagagatgattaccgcctactacttcgactactggggccagggaagcagcgtgaccgttagctctctggaaagaacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3606 - DNA, 1857 bp, Artificial Sequence
  Synthetic Polynucleotide encoding a Bispecific antibody
atggccttaccagtgaccgccttgctcctgccgctggccttgctgctccacgccgccaggccggacatccagatgacacagagccctagcagcctgtctgccagcgtgggagatagagtgaccatcaactgcaaggccagccaggacatcaacagctacctgagctggttccagcagaagcctggcaaggcccctaagacactgatctaccgggccaacagactggtggatggcgtgccaagcagattttctggcagcggcagcggccaggattacaccctgacaatatccagcctccagcctgaggacttcgccacctactactgcctccagtacgacgagttccctctgacctttggcggaggcaccaaggtggaaatcaaaggcggaggcggaagtggaggcggaggatctggcggcggaggctctcaggtgcaactggtgcagtctggggccgaagtgaagaaacctggggcctctgtgaaggtgtcctgcaaagccagcggctacacctttaccaactacgacatcaactgggtccgacaggctccaggccaaggactggaatggatcggctggatctatcctggcgacggcagcaccaagtacaacgagaagttcaaggccaaggccacactgaccgccgataccagcacaagcaccgcctacatggaactgcggagcctgagaagcgacgacaccgccgtgtactattgtgcctccggctacgaggacgctatggactattggggccagggcaccaccgtgacagtgtctagtgccaagcctaccaccacaccagctccaagacctccaactcctgctcctacaatcgccagccagcctctgtctctcagacccgaagcctgtagacctgctgctggcggagctgtgcataccagaggactggatttcgcctgcgacatcacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3607 - DNA, 1725 bp, Artificial Sequence
  Synthetic Polynucleotide encoding a Bispecific antibody
atggccttaccagtgaccgccttgctcctgccgctggccttgctgctccacgccgccaggccggagatcgtgctgacacagagccctctgagcctgcctgttacacctggcgagcctgccagcatctcctgtagaagctctcagagcctgctgcacagcaacggctacaactacctggactggtatctccagaagcctggacagagcccacagctcctgatctacctgggcgtgaactctgtgtccggcgtgcccgatagattttctggcagcggctctggcaccgacttcaccctgaagatcagcagagtggaagccgaggacgtgggcgtgtactactgtatgcaggccctccagacaccttggacattcggccagggcaccaaggtggaaatcaaaggcggcggaggatctggcggaggtggaagtggcggaggcggatctcaagtgcaactggttcagagcggagccgaagtgaagaaacctggcagcagcgtgaaggtgtcctgcaaagcctctggcggcatcttcagcaaccacgccatctcttgggtccgacaggctcctggacaaggactggaatggatgggcggcatcatccccatcttcggcacagccaattacgcccagaaattccagggcagagtgaccatcaccgccgacgagtctaccagcaccgccttcatggaactgagcagcctgagaagcgaggacaccgccgtgtactattgcgccagagaatgggccgacgtgttcgacatttggggccagggaacaatggtcaccgtgtcctctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3608 - DNA, 1722 bp, Artificial Sequence
  Synthetic Polynucleotide encoding a Bispecific antibody
atggccttaccagtgaccgccttgctcctgccgctggccttgctgctccacgccgccaggccggacatccagatgacacagtctccagccagcctgaccgtgtcactgggacagagagccaccatctcttgcagagccagcgagagcgtggacagctacggcaatagctacctgcactggtatcagcagaagcccggccagcctcctcagctcctgatctacctggcctccaatctggaaagcggcgtgccagccagattttctggcagcggcagcagaaccgacttcaccctgaccattgatcccgtggaagccgatgatgccgccacctactactgccagcagaacaacgaggacccctggacatttggcggaggcaccaaggtggaaatcaaaggcggcggaggatctggcggaggtggaagtggcggaggcggatctgaagttcagctccagcagagcggagccgagcttgtgaaacctggcgcttccgtgaagatgagctgcaaagccttcggctacaccttcaccacctttccaatcgagtggatgaagcagagccacggcaagagcctggaatggatcggcaactttcacccctacaacgaccagaccaagtacaacgaagagttcaagggcagagccaagctgaccatcgacagatccagcagcaccgtgtacctggaactgggcagactgacctccgatgacagcgccgtgtactactgtgccagaggctactactacgccttcgacttttggggccagggcaccacactgacagtgtctagcacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3609 - DNA, 1713 bp, Artificial Sequence
  Synthetic Polynucleotide encoding a Bispecific antibody
atggccttaccagtgaccgccttgctcctgccgctggccttgctgctccacgccgccaggccggacatccagatgacacagagccctagcagcctgtctgccagcgtgggagacagagtgaccatcacctgtagagccagccagggcatcagaaacgacctcggctggtatcagcagaagcctggcaaggcccctaagcggctgatctatgccgcttcctctctgcaatctggcgtgcccagcagattttctggcagcggctctggcaccgagttcaccctgacaatatccagcctccagcctgaggacttcgccacctactactgcctccagcacaacagctacccctggacctttggacagggcaccaagctggaaatcaaaggcggaggcggaagtggaggcggaggatctggcggcggaggctctgaagtgcaactggttgaatctggcggcgctctgattcagcctggcggatctctgagactgagctgtgtggcctccggctttaccatcagcggcaactacatgagctgggtccgacaggcccctggcaaaggacttgaatgggtgtccctgatctacagcggcgacagcacctattacgccgacagcgtgaagggcagattcaccatcagccgggacatcagcaagaacaccgtgtacctccagatgaactccctgagagtggaagataccgccgtgtactactgcgtccgcgacggctactacgtgtccgatatggttgtgtggggcaagggcaccaccgtgacagtctcttctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3610 - DNA, 1743 bp, Artificial Sequence
  Synthetic Polynucleotide encoding a Bispecific antibody
atggccttaccagtgaccgccttgctcctgccgctggccttgctgctccacgccgccaggccggatgtgctgctgacccagagccctctgagcctgcctgtgacactgggacagcctgccagcatctcctgtcggagcagccagaccatcgtgcacagcaacggcaacacctacctggaatggttccagcagcggccaggccagagccccagactgctgatctaccaggtgtccaacagattcagcggcgtgcccgacagattctccggcagcggctctggcaccgacttcaccctgaagatcagccgggtggaagccgaggacgtgggcgtgtactactgttttcaaggcagccacgtgccccggacctttggcggaggaacaaaggtggaaatcaagagaggcggaggcggaagtggaggcggaggatctggcggcggaggctctcagatccaactggtgcagagcggcagcgagctgaagaaacctggggccagcgtgaaggtgtcctgcaaggccagcggctacacctttaccaactacggcatgaactgggtgcgccaggcccctggacagggcctgaaatggatgggctggatcaacaccaacaccggcgagcctaagtacgccgaagagttcaagggcagattcgccctgagcctggacaccagcgtgtccacagcctacctccagatcaacagcctgaaggccgaggataccgccgtgtacttctgcgccagaggctacggcaactacgccagaggggcttggctggcctattggggccagggaacactcgtgaccgtgtcctctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3611 - DNA, 1704 bp, Artificial Sequence
  Synthetic Polynucleotide encoding a Bispecific antibody
atggccttaccagtgaccgccttgctcctgccgctggccttgctgctccacgccgccaggccggacgagatcgtgctgacacagagccctgccacactctctctgagccctggcgaaagagccaccctgagctgtagcgccagcagcagcatcaactacatctactggctccagcagaagcccggccaggcccccagaatcctgatctacctgaccagcaacctggcctccggcgtgccagccagattttctggcagcggctccggcaccgacttcaccctgacaatcagcagcctggaacccgaggacttcgccgtgtactactgcctccagtggtccagcaaccccctgacctttggcggaggcaccaaggtggaaatcaagggcggaggcggaagtggaggcggaggatctggcggcggaggctctttcgaagtgcaactggtggaaagcgggggaggacttgtgaagcctggcggctctctgagactgagctgtgccgcctctggcttcaccttcagcagctacgacatgagctgggtgcgccaggctcctggcaagggactggaatgggtgtccaccatcagcagcggcggcagctacacctactacctggacagcatcaagggccggttcaccatctccagagacaacgccaagaacagcctgtacctccagatgaactccctgcgggccgaggacacagccgtgtattattgcgccagacagggcctggattactggggcagaggcacccttgtgaccgtgtcctctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3612 - DNA, 1728 bp, Artificial Sequence
  Synthetic Polynucleotide encoding a Bispecific antibody
atggccttaccagtgaccgccttgctcctgccgctggccttgctgctccacgccgccaggccggacatcgtgatgacccagagccccgatagcctggccgtgtctctgggagagagagccaccatcaactgccgggccagcaagagcgtgtccaccagcggctacagcttcatgcactggtatcagcagaagcccggccagccccccaagctgctgatctacctggcctccaacctggaaagcggcgtgcccgatagattcagcggcagcggctctggcaccgacttcaccctgaccatcagttctcttcaggccgaggacgtggccgtgtactactgccagcacagcagagaggtgccctggacattcggccagggcacaaaggtggaaatcaagcggggcggaggcggaagtggaggcggaggatctggcggcggaggctctcaggtgcagctggtgcagtctggggccgaagtgaagaaacctggggccagcgtgaaggtgtcctgcaaggccagcggatacacctttaccaactacggcatgaactgggtgcgccaggcccctggacagggcctggaatggatgggctggatcaacacctacaccggcgagcccacatacgccgacgccttcaagggcagattcgccttcagcctggacaccagcacctccaccgcctacctccagatcaacagcctgcggagcgacgacaccgccgtgtattattgcgccagagattacggcgactacgggatggactattggggccagggaaccaccgtgaccgtgtcctctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3613 - DNA, 1716 bp, Artificial Sequence
  Synthetic Polynucleotide encoding a Bispecific antibody
atggccttaccagtgaccgccttgctcctgccgctggccttgctgctccacgccgccaggccggacatcgtgatgacccagacccccctgaccctgagcgtgacaatcggacagcctgccagcatctcctgcaagagcagccagagcctgctggacagcgacggcaagacctacctgaactggctgctgcagaggccaggccagagccccgagagactgatctacctggtgtccaagctggactccggcgtgcccgatagattcacaggcagcggctccggcaccgacttcaccctgaagatcagccgggtggaagccgaggacctgggcgtgtactgttgttggcagggcacccacttcccttacaccttcggcggagggaccaaggtggaaatcaagggcggcggaggcggaagtggaggcggaggatctggcggcggaggctctcaggtgcaactgcagcagcctggcgctgaacttgtgcggccaggcgcctctgtgaagctgagctgtaaagccagcggctacaccttcaccagctactggatgaactgggtcaagcagcgcccaggccagggcctggaatggatcggaatgatcgaccccagcgacagcgagacacactacaaccacatcttcaaggacaaggccaccctgaccgtggacaagtccagcagcacagcctacctgcaactgtccagcctgaccagcgaggacagcgccgtgtactactgcgcccggaacctgtatctgtggggccagggaacaagcgtgaccgtgtctagcacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3614 - DNA, 1728 bp, Artificial Sequence
  Synthetic Polynucleotide encoding a Bispecific antibody
atggccttaccagtgaccgccttgctcctgccgctggccttgctgctccacgccgccaggccggacgacatccagttgacccagtcccccagctcactcagcgccagtgtgggggaccgggtgaccattacctgtaaagccagtcagagtgtggactatgagggggatagcttcctgaattggtatcagcagaagcctggcaaagccccaaagctgctgatctacgctgcatctaatctggagtcaggcgtgccttctaggttctccggtagtgggtctgggaccgatttcacattgaccatttcatccctccaacccgaggatttcgctacatattactgtcagcagtccaatgaggaccctctcacctttggccagggcaccaaagttgaaattaagagaggcggaggcggaagtggaggcggaggatctggcggcggaggctctgaagtccaacttgtggagtctggagggggcctggtgcagcccggcggctctctcagactgtcttgtgcggcaagcggctacaccttcagctcttactggatagaatgggtgaggcaggcacctggaaagggactggagtggattggagagattctgccaggagggggagatacaaattacaatgaaatcttcaaggggcgggccaccttttcagcggataccagcaagaatacagcttacctgcagatgaatagcctccgggcagaagataccgctgtttattattgcacgagacgggtgccaataagactggactattgggggcaagggactcttgtcaccgtcagttcaacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3615 - DNA, 1716 bp, Artificial Sequence
  Synthetic Polynucleotide encoding a Bispecific antibody
atggccttaccagtgaccgccttgctcctgccgctggccttgctgctccacgccgccaggccggacatcgtgatgacccagacacctctgagcctgagcgtgacacctggacagcctgccagcattagctgcaagagcagccagtctctgctggacggcgacggcaagacctacctgaattggctgctccagaagcctggacagagccctcagcggctgatctacctggtgtccaagctggatagcggcgtgcccgatagattttctggcagcggctctggcaccgacttcaccctgaagatcagcagagtggaagccgaggacgtgggcgtgtactactgttggcagggcacacacttccccagaacattcggccagggcacaaagctggaaatcaaaggcggaggcggaagtggaggcggaggatctggcggcggaggctctcaagtgcaactggttcagagcggagccgaagtgaagaaacctggggcctctgtgaaggtgtcctgcaaggccagcggctacaccttcaaggacacctacatccactgggtccgacaggcccctggacaaggacttgagtggatgggcagaatcgaccccgccaacggcaacaccaaatacgaccccaagttccagggcagagtgaccatgaccagagacaccagcatcagcaccgcctacatggaactgagccggctgagatccgatgacaccgccgtgtactattgcgctagaagaggcggagtggattggggccagggaacactggttaccgtgtctagtacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3616 - DNA, 1740 bp, Artificial Sequence
  Synthetic Polynucleotide encoding a Bispecific antibody
atggccttaccagtgaccgccttgctcctgccgctggccttgctgctccacgccgccaggccggacatcgtgatgacccagagccccgatagcctggccgtgtctctgggagagagagccaccatcaactgcgagagcagccagagcctgctgaacagcggcaaccagaagaactacctgacctggtatcagcagaagcccggccagccccccaagcccctgatctattgggccagcaccagagaaagcggcgtgcccgatagattcagcggcagcggaagcggcaccgacttcaccctgaccatcagttctcttcaggccgaggacgtggccgtgtactactgccagaacgactacagctacccctacaccttcggccagggcaccaagctggaaatcaagagaggcggaggcggaagtggaggcggaggatctggcggcggaggctctgaagtgcagctggtgcagtctggggccgaagtgaagaagcctggcgagagcctgaagatcagctgcaagggcagcggctacagcttcaccgactactacatgaagtgggccagacagatgcccggcaagggcctggaatggatgggcgacatcatccccagcaacggggccaccttctacaaccagaaattcaagggccaagtgaccatctccgccgacaagagcatcagcaccacctacctccagtggtccagcctgaaggccagcgacaccgccatgtactattgcgccagaagccatctgctgcgggccagttggttcgcctattggggccagggaacaatggtcacagtgtccagcacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3617 - DNA, 1725 bp, Artificial Sequence
  Synthetic Polynucleotide encoding a Bispecific antibody
atggccttaccagtgaccgccttgctcctgccgctggccttgctgctccacgccgccaggccggacatcgtgctgacacagagccctgcttctctggccgtgtctctgggacagagagccaccatcagctgtagagccagcgagagcgtggacaactacggcaacaccttcatgcactggtatcagcagaagcccggccagcctcctaagctgctgatctacagagccagcaacctggaaagcggcatccccgccagattttctggcagcggcagcagaaccgacttcaccctgaccatcaatcccgtggaagccgacgacgtggcaacctactactgccagcagagcaacgaggaccctcctacatttggagccggcaccaagctggaactgaaaggcggaggcggaagtggaggcggaggatctggcggcggaggctctcagattcagctggtgcagtctggccccgagctgaagaaacctggcgagacagtgaagatcagctgcaaggccagcggctacatcttcaccaattacggcatgaactgggtcaagcaggcccctggcaagagcttcaagtggatgggctggatcaacacctacaccggcgagagcacatacagcgccgacttcaagggcagattcgccttcagcctggaaaccagcgccagcacagcctacctgcacatcaacgacctgaagaacgaggacaccgccacctacttttgcgccagaagcggcggctacgaccctatggattattggggccagggcaccagcgtgaccgtttcttctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3618 - DNA, 1737 bp, Artificial Sequence
  Synthetic Polynucleotide encoding a Bispecific antibody
atggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaaggcggaggcggaagtggaggcggaggatctggcggcggaggctctgaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3619 - DNA, 1737 bp, Artificial Sequence
  Synthetic Polynucleotide encoding a Bispecific antibody
atggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaaggcggaggcggaagtggaggcggaggatctggcggcggaggctctcaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3620 - DNA, 1719 bp, Artificial Sequence
  Synthetic Polynucleotide encoding a Bispecific antibody
atggccttaccagtgaccgccttgctcctgccgctggccttgctgctccacgccgccaggccggagatcgtgctgacacagagccctggcacactgtcactgtctccaggcgaaagagccacactgagctgtagagccagccagagcgtgtccagctcttacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgccagcaggactacggcttcccttggacctttggacagggcaccaaggtggaaatcaagagaggcggaggcggaagtggaggcggaggatctggcggcggaggctctgaagttcaactggttcagagcggagccgaagtgaagaagcctggcgagagcctgaagattagctgcaaaggctccggctactccttcaccagctactggatctcttgggtccgacagatgcccggcaaaggactggaatggatgggcatcatcgaccccagcgacagcgacaccagatacagccctagcttccagggccaagtgaccatcagcgccgacaagagcatcagcacagcctacctccagtggtcctctctgaaggccagcgataccgccatgtactattgcgccagaggcgacggcagcaccgacctggattattggggacagggaaccctggtcaccgtgtctagtacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3621 - DNA, 1725 bp, Artificial Sequence
  Synthetic Polynucleotide encoding a Bispecific antibody
atggccttaccagtgaccgccttgctcctgccgctggccttgctgctccacgccgccaggccgcagttcgtgctgacacagcctccaagcgtgtccaccaatcctggcagcacagtgaagctgagctgcaagagaaacaccggcaacatcggcagcaactacgtgaactggtatcagcagaagcccggacagagccccaccaccatgatctacagagatgacaagaggcccgacggcgtgcccgatagattttccggctctatcgacagaagcagcaacagcgccctgctgaccatcaacaacgtgcagacagaggacgaggccgactacttctgccagagctacagcagcggcatcaacatcatcttcggcggaggcaccaagctgacagttcttggcggaggcggaagtggaggcggaggatctggcggcggaggctctcaagtgcagctccaagaatctggccctggcctggtcaagcctagcgagacactgagcctgacctgtaccgtgtccggctttagcctgaccacctacgacgtgcactgggtccgacaacctccaggcaaaggactggaatggatgggcagaatccagaacgccggcatcaccgactacaatagcgccctgaagtcccggctgattatctccagagacaccagcaagagccaggtgttcctgaagatgaacagcgtgaccaccgccgacaccgccatgtacttttgtgccaagaccggcagctacttctacgccttcgatcactggggccagggcacactggttaccgtttcttctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3622 - DNA, 1716 bp, Artificial Sequence
  Synthetic Polynucleotide encoding a Bispecific antibody
atggccttaccagtgaccgccttgctcctgccgctggccttgctgctccacgccgccaggccggacatccagatgacacagtctccagccagcctgtctgcctctctgggagagacagtgaccatcgagtgcagacccagcgaggacatccacagcaacgtggcctggtatcagcagaagcccggcaattctccccagctgctgatctacgacgccagcaatctggctgatggcgtgcccagcagattttctggcagcggctctggcacacagtacagcctgaagatcaacagcctccagagcgaggacgtggcctcctacttctgccaccagtacaacatctacccctacaccttcggcagcggcaccaagctggaacttaaaggcggaggcggaagtggaggcggaggatctggcggcggaggctctcaagttcagctgcaagagtctggccccacactggtcaagcctggcgatagcgtgaagatgagctgcaaggccagcggctacacctttaccgactacatcatccactgggtcaagcagagccacggcaagagcctggaatggatcggctacatcaacccttacagcgacggcaccaactacaacgagaagttcaagagcaaggccacactgaccgtggacaagagcaccagcacagcctacatggaattttcccggctgacctccgaggacagcgccatctatttctgcgccctgaactacggcagctactacgctatggatgcctggggccagggcacaagcgtgacagtttcttctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3623 - DNA, 1719 bp, Artificial Sequence
  Synthetic Polynucleotide encoding a Bispecific antibody
atggccttaccagtgaccgccttgctcctgccgctggccttgctgctccacgccgccaggccggagatcgtgctgacacagtctcccgccacactgtcactgtctccaggcgaaagagccacactgagctgtagagccagccagagcgtgtcctcttacctggcctggtatcagcagaagcctggacaggctccccggctgctgatctacgatgccagcaatagagccacaggcatccccgccagattttctggctctggcagcggcaccgatttcaccctgaccataagcagcctggaacctgaggacttcgccgtgtactactgccagcagagaagcaactggcccctgacctttggacagggcaccaaggtggaaatcaagagaggcggaggcggaagtggaggcggaggatctggcggcggaggctctgaagttcagctccttgagagtggtggcggcctggttcaacctggcggatctctgagactgtcttgtgccgccagcggcttcacctttagcggctattggatgcactgggtccgacaggcccctggcaaaggacttgaatgggtgtccgccatcagaagcgacggcagcagcaagtactacgccgactctgtgaagggcagattcaccatcagccgggacaacagcaagaacaccctgtacctccagatgaacagcctgagagccgaggacacagccgtgtattattgcgccaaggacggcgtgatcgaggacacctttgattactggggccagggcaccctggtcaccgtttcttctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3624 - DNA, 1707 bp, Artificial Sequence
  Synthetic Polynucleotide encoding a Bispecific antibody
atggccttaccagtgaccgccttgctcctgccgctggccttgctgctccacgccgccaggccggacgtgcagatcacacagagccctagctacctggctgcctctcctggcgagacaatcaccatcaactgtcgggccagcaagagcatcagcaaggacctggcctggtatcaagagaagcccggcaagaccaacaagctgctgatctacagcggcagcacactccagtctggcatccccagcagattttccggctctggcagcggcaccgatttcaccctgaccataagcagcctggaacctgaggacttcgccatgtactactgccagcagcacaacaagtacccctacacctttggcggaggcaccaagctggaaatcaagagaggcggaggcggaagtggaggcggaggatctggcggcggaggctctcaagttcaactgcaacagcctggggccgagcttgttagacctggcgcttctgtgaagctgagctgcaaggccagcggctacaccttcaccagctactggatgaactgggtcaagcagcggcctgaccagggcctcgaatggatcggcagaatcgacccctacgacagcgagacacactacaaccagaagttcaaggacaaggccatcctgaccgtggacaagagcagctccaccgcctacatgcaactgagcagcctgacctctgaggatagcgccgtgtactattgcgccagaggcaactgggacgactattggggccagggcacaaccctgacagtgtctagtacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3625 - DNA, 1800 bp, Artificial Sequence
  Synthetic Polynucleotide encoding a Bispecific antibody
atggccttaccagtgaccgccttgctcctgccgctggccttgctgctccacgccgccaggccgtacatcaacatctacaacgccgagcctgccaatcctagcgagaagaacagccccacacagtacgcctacggcagcggagaattcgacatccagatgacacagtctccagccagcctgtctgcctctctgggagagacagtgaccatcgagtgccggaccagcaaggacatctacagcaacctggcctggttccagcaagagcccggcaattctcctcagctcctgatctacgacgccagcaatctggctgatggcgtgcccagcagattttctggcagcggctctggcacacagtacagcctccagatcaacaacctccagagcgaggacgtggcctcctacttctgccaccagtacaacaactacccctacaccttcggcaccggcaccaagctggaacttaaaggcggaggcggaagtggaggcggaggatctggcggcggaggctctcaagtgcagctccaagagtctggccccacactggtcaatcctggcgacagcgtgaagatgagctgcaaggccagcggctacacctttaccgaccacatcatccactgggtcaagcagagccacggcaagagcctggaatggatcggctacatcaacccctatagcggcggagccaactacaacggcaagttcaagagcaaggccacactgacaatcgacaagagcagcagcaccgcctacatggaattttccagactgaccagcggcgactccgccatctactactgcgccctgaattacggcagctactacgctatggatgcctggggccagggcacaagcgtgacagtttcttctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3626 - DNA, 1713 bp, Artificial Sequence
  Synthetic Polynucleotide encoding a Bispecific antibody
atggccttaccagtgaccgccttgctcctgccgctggccttgctgctccacgccgccaggccggagatcgtgctgacacagagccctaccagcatgacagcctctccaggcgagcaagtgaccatcacctgtagagccagcagcagcatcaactacatgcactggtatcagcagaagcctggcgcaagccccagaccttggatctacgagacaagcaagctggcctccggcgtgcccgatagattttctggatctgccagcggcaccagctacagcctgaccatcaacaacatggaagccgaggacgccgccacctactactgccagcagtggaattacccctcctggacctttggcggaggcaccaagctggaacttaaaggcggaggcggaagtggaggcggaggatctggcggcggaggctctgaagtgcagctcgttgagtctggtggcggactggttcagcctggaagaagcctgaagctgagctgtgccgccagcggcttcaccttcagcgactacaatatggcctgggtccgacaggcccctaagaaaggactggaatgggtcgccaccatcctgtacgatggcggcagaacctactaccggggcagcgtgaagggcagattcaccatcagcagagacaacgccaagagcaccctgtacctgcggatggactctctgagaagcgaggataccgccacatattactgtgccacacacagccggggcaccgactactttgattattggggccagggcgtgatggttaccgtgtctagtacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3627 - DNA, 1740 bp, Artificial Sequence
  Synthetic Polynucleotide encoding a Bispecific antibody
atggccttaccagtgaccgccttgctcctgccgctggccttgctgctccacgccgccaggccggacatcgtgatgacacagagcccttctagcctggccgtgtctgagggcgagacagtgaccatcaactgcaagagcagccagagcttcctgtctagcggcgacggcaagaattacgtggcctggtatcagtacaagcccggacagagccccaagctgctgatctactgggccagcacaagacagagcggcgtgcccgatagattcatcggctctggcagcggcaccgacttcaccctgacaatctctacagtgcaggccgaggacctggctatctactactgccagcagtattacgacacccctctgacctttggctccggcaccaagctggaaatcaaaggcggaggcggaagtggaggcggaggatctggcggcggaggctctgaagtgaagctgcaagagtctggccccagcctggtgcagagtagccaaacactgagcctgacctgtaccgtgtccggctttagcctgaccagctaccacatccactgggtccgacagacccctggcaaaggactggaatggatgggcgtgatgtggagcgacggcgacaccagctataacagcgccctgaagtcccggctgagcatcagcagagatacaagccagagccaggtgttcctgaagatgaacagcctccagaccgaggacaccgccacctactattgtgccagaggctactacagcagctacctgtacctttggttcgcctattggggccagggcaccctggttacagtcagctctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3628 - DNA, 1752 bp, Artificial Sequence
  Synthetic Polynucleotide encoding a Bispecific antibody
atggccttaccagtgaccgccttgctcctgccgctggccttgctgctccacgccgccaggccggacgtgctgatgacccagacacctgtgtctctgccagtgtctctcggaggccaggtgtccatctcctgtagaagcagccagagcctggtgcactccgacggcgatacctacctgcactggtatctccagaagcctggacagagccctcagctcctgatctaccgggtgtccaacagattcagcggcgtgcccgatagattttccggcagcggctctggcaccgacttcaccctgaagatcagcagagtggaacccgaggacctgggcctgtactactgtctccagaccacacacttcccaccttggacctttggcggaggcaccaagctggaaatgaaaggcggaggcggaagtggaggcggaggatctggcggcggaggctctcaggttcagctccagcagtctggacccgagcttagaaggccaggatctagcgtcagactgagctgcaaggccagcggctaccggatcaaggacttcctgatccactggattaagaacagacccgagcacggcctggaatggatcggatggattgaccctgaggacggcgagactaagtacgcccagaagttccagaccaaggccacactgaccgccgacacctctagcaacaccgcctacatgcaactgagcagcctgaccagcgaggacaccgccacctacttttgtgctagatggggcgacgtgtactacggcctgatgagaggccatgtgatggatgcctggggccagggaacaagcgtgacagtctcttctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3629 - DNA, 1725 bp, Artificial Sequence
  Synthetic Polynucleotide encoding a Bispecific antibody
atggccttaccagtgaccgccttgctcctgccgctggccttgctgctccacgccgccaggccggacatccagatgacccagtctaccagttccctgagtgcatccctcggagacagggtgacgatcagttgcagcgcaagccaagggatcaataactatctgaactggtatcagcagaaaccggacggaacagtcgaactcctgatttattacaccagcacccttcagagtggcgtcccttcccggttcagtggctccggaagcgggaccgattactccctgaccatttctaatctggagccagaggacataggaacgtattattgccagcagtatagtaaactgccacgaacttttggaggggggacgaaactggagatcaaaggcggaggcggaagtggaggcggaggatctggcggcggaggctctcaggtgcaactccagcagtccggaagcgagcttatgatgccaggggcatcagtgaagatcagctgcaaggctactggctacaccttctctaattactggatagagtgggttaaacaaaggccagggcacggcctggaatggatcggcgagatcctgcctgggacaggccgaaccatttataacgagaagttcaaaggcaaggctactttcaccgcagatataagctctaatacagtgcaaatgcagctctcttccctgacaagtgaggatagtgccgtgtattattgcgcacgaagagattactatggaaatttttattacgctatggattattggggtcaaggaacaagtgtgaccgttagcagcacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3630 - DNA, 1710 bp, Artificial Sequence
  Synthetic Polynucleotide encoding a Bispecific antibody
atggccttaccagtgaccgccttgctcctgccgctggccttgctgctccacgccgccaggccggacatccagatgacccagagccctgccagcctgtccgtgtctgtgggcgagacagtgaccatcacctgtcgggccagcgagaacatctacagcaacctggcctggtatcagcagaagcagggcaagagcccccaactgctggtgtacgccgccaccaatctggccgatggcgtgcccagcagattttccggctctggcagcggcacccagtacagcctgaagatcaacagcctccagagcgaggacttcggcagctactactgccagcacttctggggcacctggacctttggaggaggcaccaccctggaaatcaagggcggaggcggaagtggaggcggaggatctggcggcggaggctctgaagtgcaactccagcagagcggccctgagcttgtgaagcctggcgcttccgtgaagatgagctgcaaggccagcggctacaccttcaccgactactacatgaagtggatgaagcagagccacggcaagtccctggaatggatcggcgacatcaaccccaacaacggcggcaccacctacaaccagaagttcaagggcaaggccaccctgaccgtggacaagagcagcagcaccgcctacatgcaactgaacagcctgaccagcgaggacagcgccgtgtactactgcgccagagactacggctacggctatttcgactactggggccagggcacaaccctgacagtgtcctctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3631 - DNA, 1719 bp, Artificial Sequence
  Synthetic Polynucleotide encoding a Bispecific antibody
atggccttaccagtgaccgccttgctcctgccgctggccttgctgctccacgccgccaggccggagatcgtgctgacacagagccctggcaccctgagcctgtctccaggcgaaagagccacactgagctgtcgggcctctcagagcgtgggaggctacctggcttggtatcagcagaagccaggccaggcccccagactgctgatctacgacgccagcaatcgggccacaggcatccccgccagattttctggcagcggctccggcaccgacttcaccctgacaatcagcagcctggaacccgaggacttcgccgtgtactactgccagcagcggaacaactggccccccatgtacacattcggccagggcaccaagctggaaatcaagagaggcggaggcggaagtggaggcggaggatctggcggcggaggctctcaggtgcaactggtgcagagcggagccgaagtgaagaaacccggcagcagcgtgaaggtgtcctgcaaggcttccggcggcaccttcagcagctacgccatttcttgggtgcgccaggctcctggacagggcctggaatggatgggcggcatcatccctatcctgggcaccgccaactacgcccagaaattccagggcagagtgaccatcaccgccgacgagagcaccagcaccgcctacatggaactgagcagcctgcggagcgaggacacagccgtgtattattgcgccagatggggcggaggggccttcgacatttggggccagggaacaatggtcaccgtgtccagcacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3632 - DNA, 1704 bp, Artificial Sequence
  Synthetic Polynucleotide encoding a Bispecific antibody
atggccttaccagtgaccgccttgctcctgccgctggccttgctgctccacgccgccaggccgcagatcgtgctgacacagagccctgccctgatgagcgccagccctggcgagaaagtgaccatgacctgtagcgccagcagcagcgtgcgctacatgtactggtatcagcagaagcccagaagcagccccaagccctggattcacctgaccagcaatctggcctctggcgtgcccgctagattttccggctctggcagcggcaccagctacagcctgaccatcagcagcatggaagccgaggacgccgccacctactactgccagcagtggtccagccaccccttcacatttggctccggcaccaagctggaaatcaagggcggaggcggaagtggaggcggaggatctggcggcggaggctctgatgtgcaactccaggaaagcggccctggccttgtgaagcctagccagagcctgtccctgacctgtaccgtgaccggcttcagcatcaccagcgactactcttggaactggatcagacagttccctggcaacaaactggaatggatgggctacatcagctactccggccacacctcctacaaccccagcctggaaagccggatctccatcaccagagacaccagcaagaaccagttcttcttgcaactgaacagcgtgaccaccgaggataccgccacatattactgtaccagaggcaactgggacgtggtgtactggggccagggcacacttgtgaccgtgtctgctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3633 - DNA, 1734 bp, Artificial Sequence
  Synthetic Polynucleotide encoding a Bispecific antibody
atggccttaccagtgaccgccttgctcctgccgctggccttgctgctccacgccgccaggccggacgtcgtgatgacccagagccctctgagcctgcctgtgacactgggacagcctgccagcatctcctgtcggagcagccagagcatcgtgcacagcgacggcaacacctacctggaatggtatcagcagcggccaggccagagccccagacggctgatctacaaggtgtccaacagattcagcggcgtgcccgacagattctccggcagcggctctggcaccgacttcaccctgaagatcagcagagtggaagccgaggacgtgggcgtgtactactgttttcaaggcagccacgccccctggacctttggcggaggaacaaaggtggaaatcaagggcggaggcggaagtggaggcggaggatctggcggcggaggctctgaagtgcaactggtggaatcaggcggcggactggtgcagcctggcggatctctgagactgagctgtgccgccagcggcttcaccttcagcagctacggaatgcactgggtgcgccaggcccctggcaaaggactggaatgggtggcctacatcaccaccagaagcagcaccatctactacgccgacagcgtgaagggccggttcaccatctccagagacaacgccaagaacagcctgtacctccagatgaactccctgcgggccgaggacaccgccgtgtactattgcaccagagagcccctgaccggctactacgctatggactattggggccagggcaccagcgtgaccgtgtctagtacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3634 - DNA, 1710 bp, Artificial Sequence
  Synthetic Polynucleotide encoding a Bispecific antibody
atggccttaccagtgaccgccttgctcctgccgctggccttgctgctccacgccgccaggccggacatccagatgacccagagccccagcagcctgtctgccagcgtgggcgacagagtgaccatcacctgtagagccagccagagcatcagcctgtggctgaactggtatcagcagaagcccggcaaggcccccaagctgctgatctacgccgccagcacactccagagcggcgtgccaagcagattttccggcagcggctccggcaccgacttcaccctgacaatcagctccctccagcccgaggacttcgccacctactactgccagcagtactacaccagcccctacaccttcggccagggcaccaaggtggaaatcaagagaggcggaggcggaagtggaggcggaggatctggcggcggaggctctcaggtgcaactgctggaatctggcggcggactggtgcagcctggcggatctctgagactgagctgtgccgccagcggcttcaccttcagcagctacgccatgagctgggtgcgccaggcccctggaaaaggactggaatgggtgtccgtgatccggtccagcggcagcagcacctattacgccgatagcgtgaagggccggttcaccatcagccgggacaacagcaagaacaccctgtacctccagatgaacagcctgcgggccgaggacaccgccgtgtactattgtgctaggggaggcggctacttcgactactggggccagggaacactcgtgaccgtgtcctctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3635 - DNA, 1719 bp, Artificial Sequence
  Synthetic Polynucleotide encoding a Bispecific antibody
atggccttaccagtgaccgccttgctcctgccgctggccttgctgctccacgccgccaggccggacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacgccgtgtccacactccagagcggcgtgcccagcagattttctggcagcggctccggcaccgacttcaccctgacaatcagctccctccagcccgaggacttcgccacctactactgtcagcagagcggcaccttccctcccaccacatttggacagggcaccaaggtggaaatcaagagaggcggaggcggaagtggaggcggaggatctggcggcggaggctctcaggtgcaactgctggaatctggcggcggactggtgcagcctggcggatctctgagactgagctgtgccgccagcggcttcaccttcagcagccacggaatgcactgggtgcgccaggcccctggaaagggactggaatgggtgtccgtgatctccggcagcggcagcaataccggctacgccgatagcgtgaagggccggttcaccatcagccgggacaacagcaagaacaccctgtacctccagatgaacagcctgcgggccgaggacaccgccgtgtactattgtgccagacagtggggcagctacgccttcgattcttggggccagggcaccctcgtgaccgtgtcatctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3636 - DNA, 1749 bp, Artificial Sequence
  Synthetic Polynucleotide encoding a Bispecific antibody
atggccttaccagtgaccgccttgctcctgccgctggccttgctgctccacgccgccaggccggacatcgtgatgagccagagccctagcagcctggccgtgtccgtgggcgagaaagtgaccatgagctgcaagagcagccagtccctgctgcacagcagcaaccagaagaactacctggcctggtatcagcagaagcccggccagtcccccaaggtgctgatctactgggccagcaccagagaaagcggcgtgcccgatagattcaccggcagcggctctggcaccgacttcaccctgaccatcaccagcgtgaagtccgaggacctggctgtgtactactgccagcagtattacagctacccctggaccttcggcggaggcacccggctggaaatcaaaagaggcggaggcggaagtggaggcggaggatctggcggcggaggctctgaagtgcaactccagcagagcgtggccgagcttgtgaagcctggcgcttccgtgaagatgtcctgcaaggtgtccggctacaccctgacagaccacaccatccactggatgaagcagcggcctgagcagggcctggaatggatcggctacatctaccccagggacggcatcaccggctacaacgagaagttcaagggcaaggccacactgaccgccgacaccagcagcagcacagcctacatgcaactgaacagcctgaccagcgaggacagcgccgtgtacttctgtgccagatggggctacagctacagaaactacgcctactactacgactactggggccagggcacaaccctgaccgtgtctagtacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3637 - DNA, 1740 bp, Artificial Sequence
  Synthetic Polynucleotide encoding a Bispecific antibody
atggccttaccagtgaccgccttgctcctgccgctggccttgctgctccacgccgccaggccggagatcgtgctgacacagagccctggcaccctgagcctgtctccaggcgaaagagccacactgagctgtcgggccagccagagcgtgtccagctcttacctggcctggtatcagcagaagcccggccaggctccccggctgctgatctacggaacaagcagcagagccaccggcatccccgacagattttctggcagcggctccggcaccgacttcaccctgacaatcagcagactggaacccgaggacttcgccgtgtactactgccagcagtacggcagcagccccttcacctttggcggaggcaccaaggtggaaatcaagagaggcggaggcggaagtggaggcggaggatctggcggcggaggctctcaggtgcaactccaggaatctggccccggactggctaagcccagcgagacactgagcctgacctgtaccgtgtccggcgacagcatcaccagctactactggtcctggatcagacagccccctggcaagggcctggaatggatcggctacatctactacagcggcagcaccaactacaaccccagcctgaagtccagagtgaccatcagcgtggacaccagcaagaaccagttctccctgaagctgagcagcgtgacagccgccgacaccgccgtgtattattgcgccagagatcagcggagaatcgccgctgccggcacccacttttacggcatggatgtgtggggccagggcaccaccgtgaccgtgtcatctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3638 - DNA, 1716 bp, Artificial Sequence
  Synthetic Polynucleotide encoding a Bispecific antibody
atggccttaccagtgaccgccttgctcctgccgctggccttgctgctccacgccgccaggccggacatcctgctgacccagagccccgtgatcctgtccgtgtctcctggcgagagagtgtccttcagctgtcgggccagccagagcatcggcaccaacatccactggtatcagcagcggaccaacggcagccccagactgctgattaagtacgccagcgagtccatcagcggcatccccagcagattttccggcagcggctccggcaccgacttcaccctgagcatcaacagcgtggaaagcgaggacattgccgactactactgccagcagaacaacaactggcccaccaccttcggagccggcaccaagctggaactgaagggcggaggcggaagtggaggcggaggatctggcggcggaggctctcaggtgcagctgaagcagagcggacctggcctggtgcagcctagccagagcctgtccatcacctgtaccgtgtccggcttcagcctgaccaactacggcgtgcactgggtgcgccagagccctggaaaaggactggaatggctgggagtgatttggagcggcggcaacaccgactacaacacccccttcaccagcagactgtctatcaacaaggacaacagcaagagccaggtgttcttcaagatgaacagcctccagagcaacgacaccgccatctactactgtgctagagccctgacctactatgactacgagttcgcctactggggccagggcacactcgtgacagtgtctgctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3639 - DNA, 1695 bp, Artificial Sequence
  Synthetic Polynucleotide encoding a Bispecific antibody
atggccttaccagtgaccgccttgctcctgccgctggccttgctgctccacgccgccaggccgatgacccagagccccaagttcctgctggtgtctgccggcgacagagtgaccctgacatgcaaggccagccagagcgtgaacaacgacgtgtactggtatcagcaggaacccggccagtcccccaagctgctgatctactgggccagcaccagagaaagcggcgtgcccgatagattcaccggcagcggctctggcaccgacttcaccctgacaatcagcagcgtgcaggccgaggacctggccgtgtactactgcaagcagagctacaacctgtacaccttcggcggaggcaccaagctggaaatcaagagaggcggcggaggatctggcggaggcggatctgggggcggaggctctgaatctggaagaggactggtgcagcctggcggcagcagaaagctgtcttgtgccgccagcggcttcaccttcagcaccagcggaatgcactgggtgcgccaggcccctgagaagggactggaatgggtggcctacatcagctccggcagcaccaccatctaccacgccgataccgtgaagggccggttcaccatcagccgggacaaccccaagaataccctgttcctccagatgaccagcctgcggagcgaggacaccgccatgtactattgctgcgccagaagcggccagttcggcaactacttcgactactggggccagggcaccaccctgaccgtgtcatctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3640 - DNA, 1710 bp, Artificial Sequence
  Synthetic Polynucleotide encoding a Bispecific antibody
atggccttaccagtgaccgccttgctcctgccgctggccttgctgctccacgccgccaggccgcagagcccatctagcctggctgtgtctgccggcgagaaagtgaccatgagctgcaagagcagccagagcctgctgaacagccggacccggaagaactacctggcctggtatcagcagaagcccggccagagccccaagctgctgatctactgggccagcaccagagaaagcggcgtgcccgatagattcaccggctctggcagcggcaccgacttcaccctgacaatcagcagcgtgcaggccgaggacctggccgtgtactactgcaagcagagcaacctgtacaccttcggcggaggcaccaagctggaaatcaagggcggaggcggaagtggaggcggaggatctggcggcggaggctctcaggtgcagctggaagagtctggacccgagcttgtgaagcctggggccagcgtgaagctgtcctgtaaagccagcggctacaccttcaccgagtacatcatccactgggtcaagcagcggagcggccagggcctggaatggatcggctggttttaccctggctccggcagcatcaagtacaacgagaagttcaaggacaaggccaccctgaccgccgacaagtccagcagcaccgtgtacatggaactgagcggcctgaccagcgaggacagcgccgtgtatttctgcgccagacacgacggctacagctacttcgactattggggccagggcaccacactgaccgtgtcctctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3641 - DNA, 1746 bp, Artificial Sequence
  Synthetic Polynucleotide encoding a Bispecific antibody
atggaaatgttccagggcctgctgctgctcctgctgctttctatgggaggcacatgggccagcagagagatgctgaggcccagatgcagacccatcaatgccacactggccgtggaaaaagagggctgccctgtctgcatcaccgtgaacaccacaatctgcgccggctactgccccaccatgacaagagttctgcaaggcgtgctgcccgctctgcctcaggtcgtgtgcaactatcgggacgtccgcttcgagagcatcagactgcctggatgtcccagaggcgtgaaccctgtggtgtcttatgccgtggctctgagctgtcagtgcgccctgtgtagaagaagcaccaccgattgcggcggacccaaggatcaccctctgacctgtgacgaccctagattccaggccagcagcagctctaaagcccctccaccttctctgccatctccaagcagactgcccggacctagcgacacacctattctgcctcaaggcggaggcggaagtggaggcggaggatctggcggcggaggctctgctcctgatgtgcaggattgccctgagtgcaccctgcaagagaaccccttcttctcccaacctggcgctcctatcctccagtgcatgggctgctgcttcagccgggcttatcccacacctctgcggagcaagaaaaccatgctggtccagaaaaacgtgaccagcgagagcacctgttgtgtggctaagagctacaacagagtgaccgtgatgggcggcttcaaggtggaaaatcacaccgcctgccactgctccacctgttactaccacaagagcacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3642 - DNA, 1719 bp, Artificial Sequence
  Synthetic Polynucleotide encoding a Bispecific antibody
atggccttaccagtgaccgccttgctcctgccgctggccttgctgctccacgccgccaggccggacatccagatgacccagagccccagcagcctgtctgcctctctgggcgagagagtgtccctgacctgtcgggccacacaggaactgagcggctacctgtcttggctgcagcagaagcccgacggcaccatcaagcggctgatctacgccgccagcaccctggatagcggcgtgcccaagagattcagcggcaacagaagcggcagcgactacagcctgaccatcagctccctggaaagcgaggacttcgccgactactactgcctgcagtacgccatctacccctacaccttcggcggaggcaccaagctggaaatcaagggcggaggcggaagtggaggcggaggatctggcggcggaggctctgaggtgcaactgcagcagtctggccccgagcttgtgaagcctggcgcctccgtgaagatgagctgcaaggccagcggctacacctttaccagctacttcatccactgggtcaagcagaaacccggccagggcctggaatggatcggcttcatcaacccttacaacgacggcagcaagtacaacgagaagttcaagggcaaggccaccctgaccagcgacaagagcagcagcaccgcctacatggaactgtccagcctgacatccgaggacagcgccgtgtactactgcaccagggacgacggctactacggctacgccatggactactggggccagggaacaagcgtcaccgtgtcctctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3643 - DNA, 1734 bp, Artificial Sequence
  Synthetic Polynucleotide encoding a Bispecific antibody
atggccttaccagtgaccgccttgctcctgccgctggccttgctgctccacgccgccaggccggacaccatcgtgctgacacagagccctgcttccctggccgtgtccctgggacagagagccaccatctcttgcagagccagcgagagcgtggacagctacggcaacagcttcatgcactggtatcagcagaagcccggccagccccccaagctgctgatctacctggcctccaacctggaaagcggcgtgcccgccagattttctggcagcggcagcagaaccgacttcaccctgaccatcgaccccgtggaagccgatgatgccgccacctactactgccagcagaacaactacgacccctggaccttcggcggaggcaccaagctggaaatcaagggcggaggcggaagtggaggcggaggatctggcggcggaggctctgaagtgcaactccagcagagcggccctgagcttgtgaagcctggcgcttccgtgaagatgagctgcaaggccagcggctacaccttcaccagctacgtgatgcactgggtcaagcagaaacctggacagggcctggaatggatcggctacatcaacccctacaacgacggcaccaagtacaacgagaagttcaagggcaaggccaccctgacaagcgacaccagcagcagcaccgcctacatggaactgaacagcctgaccagcgaggacagcgccgtgtacttctgcgccagacccatctacttcgacaacgactacttcgattactggggccagggcaccaccctgaaggtgtcctctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3644 - DNA, 1719 bp, Artificial Sequence
  Synthetic Polynucleotide encoding a Bispecific antibody
atggccttaccagtgaccgccttgctcctgccgctggccttgctgctccacgccgccaggccggacatccagatgacacagagccctagcagcctgtctgccagcgtgggagacagagtgaccatcacatgcaaggccagccaggatgtgtctacagccgtggcctggttccagcagaagcctggaaaagcccctaagctgctgatctacagccccagctacagatacaccggcgtgcccagcagattttctggcagcggctctggcaccgacttcaccctgacaatatccagcctccagcctgaggacttcacctactactgccagcagctctacagcaccccttacacattcggccagggcaccaaggtggaaatcaaaggcggaggcggaagtggaggcggaggatctggcggcggaggctctgaagtgcaactggttcagagcggagccgaagtgaagaaacctggggcctctgtgaaggtgtcctgcaaagccagcggctacacctttaccgactactacctggacgtggtcgtgcggcaagctcctggacaaggactggaatggatcggcagagtgaacccctacaacggcggcaccatctacaaccagaaattcaagggaagagtgaccctgaccagagacaccagcacctccacagcctacctggaactgagcagcctgagaagcgaagataccgccgtgtactactgcgccagggaccactacagatatgaccctctgctggactactggggccagggaaccctggttacagtgtctagtacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3645 - DNA, 1737 bp, Artificial Sequence
  Synthetic Polynucleotide encoding a Bispecific antibody
atggccttaccagtgaccgccttgctcctgccgctggccttgctgctccacgccgccaggccggacatccagatgacacagagccctagcagcctgtctgccagcgtgggagacagagtgaccatcacctgtagagccagccagagcgtgtccaccagcagctacaactacatgcactggtatcagcagaagcccggcaagcctcctaagctgctgattaagtacgccagcaacctggaaagcggcgtgcccagcagattttctggcagcggctctggcaccgacttcaccctgacaatatccagcctccagcctgaggacttcgccacctactactgtcagcactcctgggagatccctctgacattcggccagggcaccaaggtggaaatcaaaggcggaggcggaagtggaggcggaggatctggcggcggaggctctgaagtgcaactggttcagagcggagccgaagtgaagaaacctggggcctctgtgaaggtgtcctgcaaggccagcggctacagcttcaccgactattatatgcactgggtccgacaggctccaggccagggacttgagtggatcggcagaatcaacccctacaacggcgctgccttctacagccagaacttcaaggatagagtgaccctgaccgtggacaccagcaccagcacagcctacctggaactgagcagcctgagaagcgaggacaccgccgtgtactactgcgccattgagagaggcgctgacctggaaggctacgctatggattattggggccagggaaccctggtcaccgtgtcatctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3646 - DNA, 1731 bp, Artificial Sequence
  Synthetic Polynucleotide encoding a Bispecific antibody
atggccttaccagtgaccgccttgctcctgccgctggccttgctgctccacgccgccaggccggagatcgtgctgacacagtctccagccacactgagcgcttctccaggcgagagagtgaccctgacctgtagagccagcagcaacgtgatctccagctacgtgcactggtatcagcagaagcctggcagcagccccagactgtttctgtacagcaccagcaatctggcctccggcgtgccaagcagattttctggctctggcagcggcaccgacttcacctttaccatctctagcctggaagccgaggacgccgccacctactactgtcagcagtacagcggctaccctctgaccttcggccagggcacaagactggaaatcaaaggcggaggcggaagtggaggcggaggatctggcggcggaggctctcaagttcagctgcaagagtctggccctggcctggtcaagcctagcgaaacactgagcctgacctgcgccgtgtctggctactctatcaccagcgcctactattggaactggatcagacagcctcctggcaaaggactggaatggatcggctacatcagctacgacggcagaaacaactacaaccccagcctgaagaaccggatcaccatcaatcccgacaccagcaagaaccagttcagcctccagctgaacagcgtgacccctgaggataccgccgtgtactactgtgccagagaaggcgactacgacgtgggcaactactacgctatggactactggggccagggaaccctggtcacagtctcttctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3647 - DNA, 1731 bp, Artificial Sequence
  Synthetic Polynucleotide encoding a Bispecific antibody
atggccttaccagtgaccgccttgctcctgccgctggccttgctgctccacgccgccaggccggagatcgtgctgacacagtctcccgccacactgtcactgtctccaggcgaaagagccacactgagctgtagagccagcagcaacgtgatctccagctacgtgcactggtatcagcagaagcctggacaggcccctcggctgctgatctacagcacaagcaatctggcctctggcatccccgccagattttctggctctggaagcggcaccgacttcaccctgaccataagcagcctggaacctgaggacttcgccgtgtactactgccagcagtatagcggctaccctctgaccttcggccagggcacaagactggaaatcaaaggcggaggcggaagtggaggcggaggatctggcggcggaggctctgaagtgcaactggtggaaagtggcggcggactggtgcaacctggaagaagcctgagactgtcctgtgccgccagcggctactctatcacaagcgcctactactggaactgggtccgacaggctcctggcaaaggactggaatgggtgtcctacatcagctacgacggcagaaacaactacaaccccagcctgaagaaccgcttcaccatcagccgggacaacgccaagaagtccctgtacctccagatgaacagcctgagagccgaggacacagccctgtactattgcgccaaagagggcgactacgacgtcggcaactactacgctatggactactggggccagggaaccaccgtgactgtctcttctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3648 - DNA, 1767 bp, Artificial Sequence
  Synthetic Polynucleotide encoding a Bispecific antibody
atggccttaccagtgaccgccttgctcctgccgctggccttgctgctccacgccgccaggccggacctgaacttcatgctgacccagccccacagcgtgtccggcagccctggaaagaccgtgaccatctcctgcaccagaagcaccggcagcatcaccagcaactacgtgcactggtatcagcagaggcccggcagcagccctaccaccgtgatctgcgaggacaacgagaggccaagcggcgtgcccgatagattcagcggctccatcgacatcagcagcaacagcgccagcctgaccatcagcggcctgaaaaccgaggacgaggccgactactactgccagagctacgacgacagcaaccacatctccgtgttcggcaccgggaccaaagtgaccgtgctgggacagcccaaggccaatcctggcggaggcggaagtggaggcggaggatctggcggcggaggctctcaggtgcaactgcaggaatctggccctggcctcgtgaagcccagcgagacactgagcctgacctgcacagtgtccggcggcagcattagcagcagcaattactactggggctggattcggcagccccctggcaagggactggaatggatcggagccatctactacagcggcagcacctactacaaccccagcctgaagtccagagtggctatcagcgtggacaccagcaagaaccagttctccctgaagctgagcagcgtgacagccgccgataccgccgtgtactactgcgccagacggatcggagtggccggacagtggtacttcgacctgtggggcagaggaaccctcgtgaccgtgtctagcacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3649 - DNA, 1725 bp, Artificial Sequence
  Synthetic Polynucleotide encoding a Bispecific antibody
atggccttaccagtgaccgccttgctcctgccgctggccttgctgctccacgccgccaggccggacatccagatgacccagagccccagcagcctgagcgccagcgtgggcgacagagtgaccatcacctgcaaggccagccaggacgtgggcatcgccgtggcctggtaccagcagaagcccggcaaggtgcccaagctgctgatctactgggccagcaccagacacaccggcgtgcccgacagattcagcggcagcggcagcggcaccgacttcaccctgaccatcagcagcctgcagcccgaggacgtggccacctactactgccagcagtacagcagctacccctacaccttcggccagggcaccaaggtggagatcaagggcggaggcggaagtggaggcggaggatctggcggcggaggctctcagatccagttggtgcagtctggacctgacctgaagaagcctggagagacagtcaagatcagttgcaaggcttctgggtataccttcacaaacactggaatgaactgggtgaagcaggctccaggaaagggtttaaagtggatgggctggataaatacctacactggagagccaacatacgctgatgacttcaagggacggtttaccttctctttggaaacctctgccagcactgcctatttgcagatcaacaacctcaaaaatgaggacacggctacatatttctgtacaagatggggctacggtagtagcctttattatgctatggactactggggtcaaggaacctcagtcaccgtctcctcaacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3650 - DNA, 1716 bp, Artificial Sequence
  Synthetic Polynucleotide encoding a Bispecific antibody
atggccttaccagtgaccgccttgctcctgccgctggccttgctgctccacgccgccaggccggacatccagatgacccagagccccagcagcctgtctgccagcgtgggcgacagagtgaccatcacatgcaaggccagccaggacgtgggaatcgccgtggcctggtatcagcagaaacccggcaaggtgcccaagctgctgatctactgggccagcaccagacacaccggcgtgcccgatagattttccggcagcggctccggcaccgacttcaccctgacaatcagctccctccagcccgaggacgtggcaacctactactgccagcagtacagcagctacccctacaccttcggccagggcaccaaggtggaaatcaagggcggaggcggaagtggaggcggaggatctggcggcggaggctctgaagtgcaactggtggaatcaggcggcggactggtgcagcctggcggatctctgagactgagctgtgccgccagcggcttcgacttcagccggtactggatgagctgggtgcgccaggcccctggcaaaggactggaatggatcggcgagatcaaccccgacagcagcaccatcaactacgcccccagcctgaaggacaagttcatcatcagccgggacaacgccaagaacagcctgtacctccagatgaactccctgcgggccgaggacaccgccgtgtactattgcgccagacccgacggcaactactggtacttcgacgtgtggggccagggaaccctcgtgaccgtgtcatctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3651 - DNA, 1719 bp, Artificial Sequence
  Synthetic Polynucleotide encoding a Bispecific antibody
atggccttaccagtgaccgccttgctcctgccgctggccttgctgctccacgccgccaggccggacatcgtgatgacccagagccagaagagcatgagcaccagcgtgggcgacagagtgagcatcacctgcaaggccagccaggacgtgatcaccggcgtggcctggtaccagcagaagcccggccagagccccaagctgctgatctacagcgccagctacagatacaccggcgtgcccgacagattcaccggcagcggcagcggcaccgacttcaccttcaccatcagcaacgtgcaggccgaggacctggccgtgtactactgccagcagcactacagcacccccctgaccttcggcgccggcaccaagctggagctgaagggcggaggcggaagtggaggcggaggatctggcggcggaggctctcaggtgcagctgcagcagcccggcgccgagctggtgagacccggcgccagcgtgaagctgagctgcaaggccagcggctacagcttcaccacctactggatgaactgggtgaagcagagacccggccagggcctggagtggatcggcatgatccaccccagcgacagcgagaccagactgaaccagaagttcaaggacaaggccaccctgaccgtggacaagagcagcagcaccgcctacatgcagctgagcagccccaccagcgaggacagcgccgtgtactactgcgccagaagcaccatgatcgccaccagagccatggactactggggccagggcaccagcgtgaccgtgagcagcacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3652 - DNA, 1725 bp, Artificial Sequence
  Synthetic Polynucleotide encoding a Bispecific antibody
atggccttaccagtgaccgccttgctcctgccgctggccttgctgctccacgccgccaggccggacatccagatgacacagagccctagcagcctgtctgccagcgtgggagacagagtgaccatcacatgcaaggccagccaggatgtgtctacagccgtggcctggtatcagcagaagcctggaaaggcccctaagctgctgatctacagcgccagctacagatacaccggcgtgcccgatagattcacaggctctggcagcggcaccgacttcaccctgacaatatctagcctccagcctgaggacttcgccacctactactgccagcagcactacagcacccctccatacacatttggcggaggcaccaaggtggaaatcaagagaggcggaggcggaagtggaggcggaggatctggcggcggaggctctcaagttcaactggttcagagcggagccgaagtgaagaaacctggggcctctgtgaaggtgtcctgcaaagccagcggctacgcctttagcagctcctggatgaactgggtccgacaggctcctggacagggcctcgaatggatcggcagaatctatcctggcgacggcgacaccaagtacaacggcaagttcaagggcaaagccacactgaccgccgacaagagcacaagcaccgcctacatggaactgagcagcctgagaagcgaggacaccgccgtgtactactgtgccagatccaccatgatcgccaccggcgctatggattattggggccagggaaccctggtcaccgtgtcatctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3653 - DNA, 1728 bp, Artificial Sequence
  Synthetic Polynucleotide encoding a Bispecific antibody
atggccttaccagtgaccgccttgctcctgccgctggccttgctgctccacgccgccaggccggacgtggtcatgacacagacacctctgagcctgagcgtgacacctggacagcctgccagcatcagctgtagaagcagccagagcctggtgcacaacaacggcaacacctacctgcactggtatctccagaagcctggacagagccctcagctgctgatctacaaggtgtccaacagattcagcggcgtgcccgacagattttctggcagcggctctggcaccgacttcaccctgaagattagcagagtggaagccgaggacgtgggcgtgtacttctgtagccagagcacacacgtgccaccttacacctttggcggaggcaccaaggtggaaatcaaaggcggaggcggaagtggaggcggaggatctggcggcggaggctctgaagtgcagctggttgagtctggtggcggactggttcaacctggcggaagcctgagactgtcttgtgccgccagcggcttcaccttcagcgactactatatggcctgggtccgacaggcccctggcaaaggacttgaatgggtcgccgagatcaactacgacggcagcagcacctactacgtggacagcgtgaagggcagattcaccatcagccgggacaacgccaagaacagcctgtacctccagatgaactccctgagagccgaggataccgccgtgtactactgcgccagagacagaggcttctacttcgactattggggccagggcaccaccgtgacagtctcttctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3654 - DNA, 1728 bp, Artificial Sequence
  Synthetic Polynucleotide encoding a Bispecific antibody
atggccttaccagtgaccgccttgctcctgccgctggccttgctgctccacgccgccaggccggacgtggtcatgacacagacacctctgagcctgagcgtgacacctggacagcctgccagcatctcctgtagaagcagccagagcctggtgcacagcaacggcctgacatacctgcactggtatctccagaagcctggacagagccctcagctcctgatctacaaggtgtccaacagattcagcggcgtgcccgacagattttctggcagcggctctggcaccgacttcaccctgaagatcagcagagtggaagccgaggacgtgggcgtgtacttctgtagccagagcacacacgtgccacctttcacctttggcggaggcaccaaggtggaaatcaaaggcggaggcggaagtggaggcggaggatctggcggcggaggctctgaagtgcagctcgttgagtctggtggcggactggttcaacctggcggaagcctgagactgtcttgtgccgccagcggcttcaccttcagcgactactatatggcctgggtccgacaggcccctggcaaaggacttgaatgggtcgccagcatcaactacgacggcgagagcacctactacgtggacagcgtgaagggcagattcaccatcagccgggacaacgccaagaacagcctgtacctccagatgaactccctgagagccgaggataccgccgtgtactactgcgccagagacagaggctactacttcgactattggggccagggcaccaccgtgacagtctcttctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3655 - DNA, 1728 bp, Artificial Sequence
  Synthetic Polynucleotide encoding a Bispecific antibody
atggccttaccagtgaccgccttgctcctgccgctggccttgctgctccacgccgccaggccggacgtggtcatgacacagagccctctgagcctgcctgtgacacctggcgaacctgccagcatctcctgtagaagcagccagagcctggtgcacagcaacggcaatacctacctgcactggtatctccagaagcctggacagagcccacagctcctgatctacaaggtgtccaaccggttcagcggcgtgcccgatagattttctggcagcggctctggcaccgacttcaccctgaagatcagcagagtggaagccgaggacgtgggcgtgtacttctgtagccagagcacacacgtgccacctttcacctttggcggaggcaccaaggtggaaatcaaaggcggaggcggaagtggaggcggaggatctggcggcggaggctctgaagtgcagctcgttgagtctggtggcggactggttcaacctggcggaagcctgagactgtcttgtgccgccagcggcttcaccttcagcgactactatatggcctgggtccgacaggcccctggcaaaggacttgaatgggtcgccgacatcaactacgatggcggcagcacctactacctggacagcctgaagtcccggttcaccatctccagagacaacgccaagaacagcctgtacctccagatgaactccctgagagccgaggataccgccgtgtactactgcgccagagacagaggctactacttcgactattggggccagggcaccctggtcacagtctcttctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3656 - DNA, 1722 bp, Artificial Sequence
  Synthetic Polynucleotide encoding a Bispecific antibody
atggccttaccagtgaccgccttgctcctgccgctggccttgctgctccacgccgccaggccggacatccagatgacccagagcagcagctacctgagcgtgtcccttggcggcagagtgaccatcacctgtaaagccagcgaccacatcaacaactggctggcctggtatcagcagaagcctggcaacgcccctagactgctgattagcggagccacctctctggaaacaggcgtgccaagcagattttccggcagcggctctggcaaggactacaccctgagcatcaccagcctccagaccgaggatgtggctacctactactgccagcagtattggagcaccccttggacctttggcggaggcaccaagctggaaatcaaaggcggaggcggaagtggaggcggaggatctggcggcggaggctctcaggttcagctccagcagtctggcgctgagcttgctagacctggcgcttctgtgaagctgagctgcaaggccagcggctacaccttcaccagctactggatgcagtgggtcaagcagaggccaggccaaggactggaatggatcggagccatctatcccggcgacggcgataccagatacacccagaagttcaagggcaaagccacactgaccgccgacaagagcagctccacagcctacatgcaactgagcagcctggcttccgaggacagcgccgtgtactattgtgccagaggcaaggtgtactacggcagcaaccctttcgcctattggggccagggaaccctggttacagtgtctgctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3657 - DNA, 1722 bp, Artificial Sequence
  Synthetic Polynucleotide encoding a Bispecific antibody
atggccttaccagtgaccgccttgctcctgccgctggccttgctgctccacgccgccaggccggacatcgtgatgacccagagccacaagttcatgagcaccagcgtgggcgacagagtgtccatcacctgtaaagccagccaggacgtgtcaacagccgtggcctggtatcagcagaagcctggacagagccccaagctgctgatctacagcgccagctacagatacaccggcgtgcccgatagattcacaggctctggcagcggcaccgacttcacctttacaatcagcagcgtgcaggccgaggacctggccgtgtattattgccagcagcactacagcacccctccatacacatttggcggaggcaccaagctggaaatcaaaggcggaggcggaagtggaggcggaggatctggcggcggaggctctcaggttcagctccagcagtctggccctgagcttgtgaaacctggcgcttccgtgaagattagctgcaaggccagcggctacgccttcagcagctcctggatgaactgggtcaagcagaggccaggccagggcctcgaatggatcggcagaatctatcctggcgacggcgacaccaagtacaacggcaagttcaagggcaaagccacactgaccgccgacaagtctagcagcaccgcctatatgcagctcagcagcctgacctctgtggacagcgccgtgtacttctgtgcccggtctaccatgattgccaccggcgctatggattactggggccagggaacaagcgtgaccgtgtcatctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3658 - DNA, 1737 bp, Artificial Sequence
  Synthetic Polynucleotide encoding a Bispecific antibody
atggccttaccagtgaccgccttgctcctgccgctggccttgctgctccacgccgccaggccgcagagcgtgctgacacagcctccatccgtgtctggcgctccaggccagagagtgaccatctcctgtaccggcagcggcagcaacatcggagccccctacgacgtgtcctggtatcagcaactgcctggcaccgcccccaagctgctgatctaccacaacaacaagcggcccagcggcgtgcccgatagattcagcggctctaagagcggcaccagcgccagcctggctatcactggactccaggccgaggacgaggccgactactactgtgccacagtggaagccggcctgagcggctctgtgtttggcggcggaacaaagctgaccgtgctgggagctggcggaggcggaagtggaggcggaggatctggcggcggaggctctcaggtgcaactggtgcagagcggagccgaagtgaagaaacctggggccagcgtgaaggtgtcctgcaaggtgtccggctacaccctgaccgagctgagcattcactgggtgcgccaggcccctggcaagggactggaatggatgggcggcttcgaccccgaagagaacgagatcgtgtacgcccagcggttccagggcagagtgacaatgaccgaggacaccagcaccgacaccgcctacatggaactgagcagcctgcggagcgaggataccgccgtgtactactgcgccatcgtgggcagcttcagccctctgacactgggcctgtggggccagggaactatggtcaccgtgtccagcacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3659 - DNA, 1737 bp, Artificial Sequence
  Synthetic Polynucleotide encoding a Bispecific antibody
atggccttaccagtgaccgccttgctcctgccgctggccttgctgctccacgccgccaggccgcagagcgtgctgacacagcctccatccgtgtctggcgctccaggccagagagtgaccatctcctgtaccggcagcggcagcaacatcggagccccctacgacgtgtcctggtatcagcaactgcctggcaccgcccccaagctgctgatctaccacaacaacaagcggcccagcggcgtgcccgatagattcagcggctctaagagcggcaccagcgccagcctggctatcactggactccaggccgaggacgaggccgactactactgccagagctacgacagcagcagcatcagcaccatcttcggcggaggcaccaagctgacagtgctgggagctggcggaggcggaagtggaggcggaggatctggcggcggaggctctcaggtgcaactggtgcagagcggagccgaagtgaagaaacctggggccagcgtgaaggtgtcctgcaaggtgtccggctacaccctgaccgagctgagcattcactgggtgcgccaggcccctggcaagggactggaatggatgggcggcttcgaccccgaagagaacgagatcgtgtacgcccagcggttccagggcagagtgacaatgaccgaggacaccagcaccgacaccgcctacatggaactgagcagcctgcggagcgaggataccgccgtgtactactgtgccatcgtgggcagcttcagcggaatcgcctacagaccttggggccagggcacaatggtcaccgtgtctagcacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3660 - DNA, 1770 bp, Artificial Sequence
  Synthetic Polynucleotide encoding a Bispecific antibody
atggccttaccagtgaccgccttgctcctgccgctggccttgctgctccacgccgccaggccggacgaattcgaggtgcagctggtagaatccggcgggggacttgtacaggctggtggtagtctgagactgagctgtgtggcctccggcatcagcagcagcaagcggaacatgggatggtataggcaagcccctggtaagcagagggaatccgtggctacaatcagcagcggcggcaacaaggactacaccgacgccgtgaaggacaggttcaccatctccagggacaccaccaagaacaccgtgtacctgcagatgaactccctcaagcccgaggacaccgccgtgtactactgcaagatcgaggccggcacaggctgggccaccagaagaggctacacatactgggggcagggaacactggtgaccgtgagctccctcgagggcggaggcggaagtggaggcggaggatctggcggcggaggctctttcgaagttcaactggtggaatccggtggaggactggtgcaagcgggcggctcactgcgccttagctgtgctgccagcggcagtatcttcagcggcaatgtaatgggttggtacaggcgacaagccccaggcaaggagcgagagtgggtagccgcgattgcaagtgggggcagcatctactacagagattctgtgaaaggccgcttcactattagtcgggacaacgcaaaaaacacggtgtatctccaaatgaacagcttgaagccagaggacactgctgtctactattgtaacagtcatcccccaactctcccctattgggggctgggcactcaggtcaccgtgagttccacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3661 - DNA, 1872 bp, Artificial Sequence
  Synthetic Polynucleotide encoding a Bispecific antibody
atggccttaccagtgaccgccttgctcctgccgctggccttgctgctccacgccgccaggccggacgaattcgaggtgcaactggtggaaagcggcggaggactggtgcaggctggcgatagcctgagactgagctgtgccgcctccggcagagccttcagcagatatgccatgggctggttcagacaggcccctggcaaagaacgcgagttcgtggccgccatcggctggggacctagcaagaccaactacgccgacagcgtgaagggccggttcaccatcagccgggacaacgccaagaacaccgtgtacctgcagatgaacaccctgaagcccgaggacaccgccgtgtactcttgcgccgccaagttcgtgaacaccgacagcacctggtcccgcagcgagatgtacacctattggggccagggcaccctcgtgaccgtgtctagtctcgagggaggaggcggctccgggggaggcggaagtggaggcggaggatctgggtctggaggaagcggatctggaggctcagggtcagggggctcaggcagtggaggctctttcgaagtgcaactggtggaatctggagggggaagcgtgcaggcaggcggatctctgagactgtcctgcaccacatctggcagagccctgaatatgtacgtgatgggatggtttcggcaggctcccggcaacgagcgggaatttgtggccgctacaagcagcagcggcggcagcacaagctaccccgattctgtgaagggcagattcacaatctcccgcgataatgccaagaatactgtgtacctgcagatgaatagtctgaagcctgaagatacagccgcctacagatgtgccgccagcccctacgtgtccacccccaccatgaacatcctggaagagtacagatactggggcctgggaacacaagtgacagtgtccagcacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3662 - DNA, 1731 bp, Artificial Sequence
  Synthetic Polynucleotide encoding a Bispecific antibody
atggccttaccagtgaccgccttgctcctgccgctggccttgctgctccacgccgccaggccggacatccagatgacccagagccccagcagcctgtctgccagcgtgggcgacagagtgaccatcacctgtagcgccagcagcagcgtgtcctacatgtactggtatcagcagaagcccggcaaggcccccaagctgctgatctacctgaccagcaatctggcctccggcgtgcccagcagattttctggcagcggctccggcaccgacttcaccctgacaatcagctccctccagcccgaggacttcgccacctactactgtcagcagtggcggagcaaccccttcaccttcggccagggcaccaagctggaaatcaagagaggcggaggcggaagtggaggcggaggatctggcggcggaggctctcagatcaccctgaaagagtccggccccaccctcgtgaagcctacccagaccctgacactgacctgcaccttcagcggcttcagcctgagcacaagcggcatgggcgtgggctggatcagacagcctcctggaaaggccctggaatggctggcccacatttggtgggacgacgtgaagcggtacagccccagcctgaagtcccggctgaccattaccaaggacaccagcaagaaccaggtggtgctgaccatgacaaacatggaccccgtggacaccgccacatattactgcgcccggatcgtgtccttcgacaacgacgtggtgtccgctatggactactggggccagggaaccctcgtgaccgtgtctagtacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3663 - DNA, 1716 bp, Artificial Sequence
  Synthetic Polynucleotide encoding a Bispecific antibody
atggccttaccagtgaccgccttgctcctgccgctggccttgctgctccacgccgccaggccggagatcgtgatgacccagagccctgccaccctgtccgtgtctccaggcgaaagagccaccctgagctgcaaggcttcccagagcgtgtccaacgacgtcgtgtggtatcagcagaagcccggccaggcccccagactgctgatctactacgccagcaacagatacaccggcatccccgccagattcagcggctctggcagcggcaccgagttcaccctgacaatcagcagcctccagagcgaggacttcgccgtgtactactgtcagcaggactacaccagcccctggaccttcggccagggcaccaagctggaaatcaagagaggcggaggcggaagtggaggcggaggatctggcggcggaggctctcaggtgcaactggtgcagagcggagccgaagtgaagaaacctggggccagcgtgaaggtgtcctgcaaggccagcggctacacctttaccaactacggcatgaactgggtgcgccaggctcctggacagggcctggaatggatgggctggatcaacacctacaccggcgagcccacctacgccgacgacttcaagggcagagtgaccatgaccaccgacaccagcacctccaccgcctacatggaactgcggagcctgagaagcgacgacaccgccgtgtattattgcgcccggatcggcgacagcagccccagcgattattggggccagggaaccctcgtgaccgtgtcctctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3664 - DNA, 1719 bp, Artificial Sequence
  Synthetic Polynucleotide encoding a Bispecific antibody
atggccttaccagtgaccgccttgctcctgccgctggccttgctgctccacgccgccaggccggacagcaccgacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacctggccagcaacctgcagagcggcgtgcccagcagattttctggcagcggctccggcaccgacttcaccctgacaatcagctccctgcagcccgaggacttcgccacctactactgtcagcaggccgagtacatgcccctgaccttcggccagggaacaaaggtggaaatcaagagagccggcggaggcggaagtggaggcggaggatctggcggcggaggctctgaagtgcaactgctggaatctggcggcggactggtgcagcctggcggatctctgagactgagctgtgccgccagcggcttcacctttagcggctacgccatgagctgggtgcgccaggctcctggcaaaggcctggaatgggtgtccgagatcgcccctcccggcctgaataccagatacgccgatagcgtgaagggccggttcaccatcagccgggacaacagcaagaacaccctgtacctgcagatgaacagcctgcgggccgaggataccgccgtgtactactgcgccaagagcgacaccgccttcgactactggggacagggaacccttgtgaccgtgtccacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3665 - DNA, 1728 bp, Artificial Sequence
  Synthetic Polynucleotide encoding a Bispecific antibody
atggccttaccagtgaccgccttgctcctgccgctggccttgctgctccacgccgccaggccggaccaggccgtgctgacccaggagagcgccctgaccaccagccccggcgagaccgtgaccctgacctgcagaagcagcaccggcgccgtgaccaccagcaactacgccaactgggtgcaggagaagcccgaccacctgttcaccggcctgatcggcggcaccaacaacagagtgcccggcgtgcccgccagattcagcggcagcctgatcggcgacaaggccgccctgaccatcaccggcgcccagaccgaggacgaggccatctacttctgcgtgctgtggcacagcaaccactgggtgttcggcggcggcaccaagctgaccgtgctgggcggaggcggaagtggaggcggaggatctggcggcggaggctctgacgtgcagctggtggagagcggcggcggcctggtgcagcccggcggcagcagaaagctgagctgcgccgccagcggcttcaccttcagcagcttcgggatgcactgggtgagacaggcccccgagaagggcctggagtgggtggcctacatcagcagcggcagcagcaccctgcactacgccgacaccgtgaagggcagattcaccatcagcagagacaaccccaagaacaccctgttcctgcagatgaccagcctgagaagcgaggacaccgccatgtactactgcgccagatggggcaactacccccactacgctatggactactggggccagggcaccagcgtgaccgtgagcagcacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3666 - DNA, 1374 bp, Artificial Sequence
  Synthetic Polynucleotide encoding a Bispecific antibody
atggccctgcccgtgacagccctgctgctgcctctggctctgctgctgcacgccgccagacccgatgaattcgaggtgcaactggtggaaagcggcggaggctctgtgcagacaggcggctctctgagactgacctgtgccgccagcggcagaaccagcagatcctatggcatgggctggttcagacaggcccctggcaaagaacgcgagttcgtgtccggcatctcttggagaggcgacagcaccggctacgccgatagcgtgaagggccggttcaccatcagccgggacaacgccaagaacaccgtggacctgcagatgaacagcctgaagcccgaggacaccgccatctactactgtgccgctgccgccggatctgcttggtacggcacactgtacgagtacgactactggggccagggcacccttgtgaccgtgtcatctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3667 - DNA, 1800 bp, Artificial Sequence
  Synthetic Polynucleotide encoding a Bispecific antibody
atggccctgcccgtgacagccctgctgctgcctctggctctgctgctgcacgccgccagacccgatgaattcgaggtgcaactggtggaaagcggcggaggctctgtgcagacaggcggctctctgagactgacctgtgccgccagcggcagaaccagcagatcctatggcatgggctggttcagacaggcccctggcaaagaacgcgagttcgtgtccggcatctcttggagaggcgacagcaccggctacgccgatagcgtgaagggccggttcaccatcagccgggacaacgccaagaacaccgtggacctgcagatgaacagcctgaagcccgaggacaccgccatctactactgtgccgctgccgccggatctgcttggtacggcacactgtacgagtacgactactggggccagggcacccttgtgaccgtgtcatctctcgagggcggaggcggaagtggaggcggaggatctggcggcggaggctctttcgaagaggtgcaactggtggaatccgggggaggcagcgtgcaggctgggggatcactgagactgtcttgtgctgcctccggcgacacctacggcagctattggatgggatggtttcggcaggctcccggaaaagaacgggaaggcgtggccgccatcaacagaggcggcggatacaccgtgtacgccgactctgtgaagggcagattcacaatctccagagacacagccaagaatactgtgtacctgcagatgaactccctgcgccccgacgataccgccgactattattgcgccgcttccggcgtgctgggcggcctgcatgaggactggttcaattattggggacagggaacacttgtgacagtgtccagcacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3668 - DNA, 1857 bp, Artificial Sequence
  Synthetic Polynucleotide encoding a Bispecific antibody
atggccctgcccgtgacagccctgctgctgcctctggctctgctgctgcacgccgccagacccgatgaattcgaggtgcagctcgtagaatctggaggtggttccgtgcaagccggaggatcattgcgactgacctgcgcagcgagcggatctacttctcgctcttacggtatgggatggttcagacaggctcctgggaaagagcgcgagttcgtttcaggcatctcctggaggggggacagcaccggctacgcagatagcgtgaagggcaggttcacgatcagccgagacaacgccaaaaacaccgtcgatctgcaaatgaatagtctgaagcccgaagatactgcgatctactactgtgccgccgcagcagggtccacctggtacggcacactctacgagtacgactactgggggcagggaaccctggtaaccgtgtcctctctcgagggaggaggcggctccgggggaggcggaagtggaggcggaggatctgggtctggaggaagcggatctggaggctcagggtcagggggctcaggcagtggaggctctttcgaagttcagctcgtggaaagcggtggcggaagtgtgcaggccggaggcagtttgcgcctgagctgcgctgcttccggcgatacatacgggtcttactggatgggctggtttaggcaggcacctggacaagaaagagaagctgtggccgctattaacaggggaggtggctataccgtttatgctgattccgtgaagggccgattcacaatctcccgggataacgccaaaaacactctgtacctgcagatgaactcccttaggcccgatgacacagccgattactattgtgcggcctccggcgtgctgggtggtctgcatgaggattggttcaactactgggggcaaggcaccctcgtaaccgtgagtagcacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3669 - DNA, 1701 bp, Artificial Sequence
  Synthetic Polynucleotide encoding a Bispecific antibody
atggccttaccagtgaccgccttgctcctgccgctggccttgctgctccacgccgccaggccggacatccagatgacccagagccccagcagcctgtctgccagcgtgggcgacagagtgaccatcacctgtagagccagccagggcatcagaaacaacctggcctggtatcagcagaagcccggcaaggcccccaagcggctgatctacgccgccagcaatctccagagcggcgtgcccagcagattcacaggctctggcagcggcaccgagttcaccctgatcgtgtctagcctccagcccgaggacttcgccacctactactgcctccagcaccacagctaccccctgacatctggcggaggcaccaaggtggaaggcggaggcggaagtggaggcggaggatctggcggcggaggctctgaggtgcaggtgctggaaagtggcggaggactggtgcagcctggcggctctctgagactgtcttgtgccgccagcggcttcaccttcagcagctacgccatgagctgggtgcgccaggcccctggaaaaggactggaatgggtgtccgccatcagcggctctggcgggtctaccaactacgccgatagcgtgaagggccggttcaccatcagccgggacaacagcaagaacaccctgtacctccagatgaacagcctgcgggccgaggacaccgccgtgtattattgtgccggcagcagcgggtggagcgagtattggggacagggcaccctcgtgaccgtgtcctctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3670 - DNA, 1719 bp, Artificial Sequence
  Synthetic Polynucleotide encoding a Bispecific antibody
atggccttaccagtgaccgccttgctcctgccgctggccttgctgctccacgccgccaggccggacgagatccagctggtgcagagcggagccgaagtgaagaagcctggcgagagcctgcggatcagctgcaagggcagcggcttcaacatcgaggactactacatccactgggtgcgccagatgcccggcaagggcctggaatggatgggcagaatcgaccccgagaacgacgagactaagtacggccccatcttccagggccacgtgaccatcagcgccgacaccagcatcaacaccgtgtacctccagtggtccagcctgaaggccagcgacaccgccatgtactactgcgcctttagaggcggcgtgtactggggccagggcaccacagtgacagtgtctagcggcggaggcggaagtggaggcggaggatctggcggcggaggctctgatgtcgtgatgacccagagccccgacagcctggctgtgtctctgggagagagagccaccatcaactgcaagtccagccagtccctgctggacagcgacggcaagacctacctgaactggctccagcagaagcccggccagccccccaagagactgatctccctggtgtccaagctggactccggcgtgcccgatagattttccggctctggcagcggcaccgacttcaccctgacaatcagctcccttcaggccgaggacgtggccgtgtactattgctggcagggcacacacttccccggcacctttggcggaggcaccaaggtggaaatcaagacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3671 - DNA, 1740 bp, Artificial Sequence
  Synthetic Polynucleotide encoding a Bispecific antibody
atggccttaccagtgaccgccttgctcctgccgctggccttgctgctccacgccgccaggccggacgagcttgtgatgacccagagccccagcagcctgacagtgacagccggcgagaaagtgaccatgagctgcaagagcagccagagcctgctgaacagcggcaaccagaagaactacctgacctggtatcagcagaagcccggccagccccccaagctgctgatctactgggccagcaccagagaaagcggcgtgcccgatagattcaccggctctggcagcggcaccgacttcaccctgacaatcagcagcgtgcaggccgaggacctggccgtgtactactgccagaacgactacagctaccccctgaccttcggagccggcaccaagctggaaatcaagggcggaggcggaagtggaggcggaggatctggcggcggaggctctgaagtgcagctgctggaacagtctggcgccgaacttgtgcggcctggcaccagcgtgaagatcagctgtaaagccagcggctacgccttcaccaactactggctgggctgggtcaagcagaggcctggacacggcctggaatggatcggcgacatctttcccggctccggcaacatccactacaacgagaagttcaagggcaaggccaccctgaccgccgacaagtctagcagcaccgcctacatgcagctgtccagcctgacctttgaggacagcgccgtgtatttctgtgcccggctgcggaactgggacgagcccatggattattggggccagggcaccaccgtgaccgtgtctagtacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3672 - DNA, 1743 bp, Artificial Sequence
  Synthetic Polynucleotide encoding a Bispecific antibody
atggccttaccagtgaccgccttgctcctgccgctggccttgctgctccacgccgccaggccggacgagctgcagatgacccagagccctagcagcctgtctgccagcgtgggcgacagagtgaccatcacctgtagagccagccagagcatcagcagctacctgaactggtatcagcagaagcccggccagccccccaaactgctgatctactgggccagcaccagagaaagcggcgtgcccgatagattcagcggcagcgagagcggcaccaactacaccctgaccatcagctccctgcagcccgaggacttcgccacctacttttgccagcagagcgacagcctgcccatcacctttggacagggcacccggctggacattcagggcggaggcggaagtggaggcggaggatctggcggcggaggctctgaggtgcaactgctggaatctgggggcggagtggtgcagcctggcagaagcctgagactgagctgtgccgccagcggcttcaccttcagctcctacggaatgcactgggtgcgccaggcccctggcaaaggactggaatgggtggccgtgatctcctacgacggcagcaacaagtactacgccgacagcgtgaagggccggttcaccatcagccgggacaacagcaagaacaccctgtacctgcagatgaacagcctgcgggccgaggacaccgccgtgtactactgcgccaaggatatgggctggggcagcggctggcggccttactactactacggcatggacgtgtggggccagggcaccaccgtgacagtgtcatctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3673 - DNA, 1734 bp, Artificial Sequence
  Synthetic Polynucleotide encoding a Bispecific antibody
atggccttaccagtgaccgccttgctcctgccgctggccttgctgctccacgccgccaggccggacgacatccaaatgacacagagtccttctagtttgagtgcgagcgtgggggacagggtgaccattacctgcagggccagccagagcataagctcataccttaattggtaccagcaaaaaccaggtaaggcccctaagctcctgatctacgcggcctcttcacttcaatctggggtcccttcccgcttcagtggctccggcagcggcaccgacttcacgctcactatatcaagtctgcagcctgaggatctcgccacctattactgtcaacaaagttattccacccctttcacctttggaccgggcacgaaagtggatattaagggcggaggcggaagtggaggcggaggatctggcggcggaggctctgtgcacgaggtccagcttgtgcagtccggggcagaggtcaagaagcctggttctagcgtaaaagtgagttgcaaagcctcaggtgggacattttcatcctacgcgatcagttgggttagacaggctcctggtcaagggctggaatggatgggcggaattattccaatcttcggaacagcgaattacgcgcagaagttccagggtagagtaaccatcactgctgacaagtccacctccaccgcatacatggaattgtctagtctccggagcgaggatacggcggtgtattattgtgctacgttcgccctgtttggcttccgcgaacaggctttcgacatctgggggcagggcacgacagtcacggttagtagtacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3674 - DNA, 1725 bp, Artificial Sequence
  Synthetic Polynucleotide encoding a Bispecific antibody
atggccttaccagtgaccgccttgctcctgccgctggccttgctgctccacgccgccaggccggacgtcgtgatgacccagacccctctgagcctgcctgtgtccctgggcgatcaggccagcatctcctgtagaagcagccagagcctggtgcacagcaacggcaacacctacctgcggtggtatctccagaagcccggccagagccccaaggtgctgatctacaaggtgtccaacagattcagcggcgtgcccgacagattctccggcagcggctctggcaccgacttcaccctgaagatcagccgggtggaagccgaggacctgggcgtgtacttctgtagccagagcacccacgtgccctggacctttggcggcggaacaaagctggaaatcaagggcggaggcggaagtggaggcggaggatctggcggcggaggctctgaagtgaagctggacgagacaggcggagggctggtgcagcctggcagacctatgaagctgagctgtgtggcctccggcttcaccttcagcgactactggatgaactgggtgcgccagtcccccgagaagggcctggaatgggtggcccagatcagaaacaagccctacaactacgaaacctactacagcgacagcgtgaagggccggttcaccatcagcagggacgacagcaagagcagcgtgtacctccagatgaacaacctgagggtggaagatatgggcatctactactgcaccggcagctactacggcatggactactggggccagggcaccagcgtgaccgtgtctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3675 - DNA, 1758 bp, Artificial Sequence
  Synthetic Polynucleotide encoding a Bispecific antibody
atggccttaccagtgaccgccttgctcctgccgctggccttgctgctccacgccgccaggccggacgtggtcatgacacagaccccactgagcctgcctgtgtctctgggagatcaggccagcatctcctgtagaagcagccagagcctggtgcacagcaacggcaacacctacctgcggtggtatctccagaagcctggacagagccccaaggtgctgatctacaaggtgtccaacagagtgtccggcgtgcccgatagattttctggcagcggctctggcaccgacttcaccctgaagatcaatagagtggaagccgaggacctgggcgtgtacttctgtagccagagcacccatgtgccttggacctttggcggaggcaccaagctggaaatcaagagcagcgccgacgacgccaagaaggacgccgccaaaaaggatgatgccaagaaagacgatgctaaaaaagacggcggcgtgaagctggacgagacaggcggaggacttgttcaacctggcggagccatgaagctgagctgtgtgaccagcggctttaccttcggccactactggatgaactgggtccgacagtcccctgagaaaggactggaatgggtcgcccagttcagaaacaagccctacaactacgaaacctactacagcgacagcgtgaagggcagattcaccatcagccgggacgacagcaagtccagcgtgtacctccagatgaacaacctgcgcgtggaagataccggcatctactactgtaccggggccagctacggcatggaatatctcggccagggcaccagcgtgaccgtgtctacaacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3676 - DNA, 1746 bp, Artificial Sequence
  Synthetic Polynucleotide encoding a Bispecific antibody
atggccttaccagtgaccgccttgctcctgccgctggccttgctgctccacgccgccaggccgcaggtgcaactggtggaatctggcggcaatctggttcagcctggcggctctctgagactgtcttgtgccgccagcggcttcaccttcggcagcttttctatgagctgggtccgacaagctcctggcggaggacttgaatgggtggcaggactgtctgccagaagcagcctgacacactacgccgactctgtgaagggcagattcaccatcagccgggacaacgccaagaacagcgtgtacctccagatgaacagcctgagagtggaagataccgccgtgtactactgcgccagaagaagctacgacagcagcggctactggggccacttctacagctacatggatgtgtggggccagggcaccctggttacagtttctggcggaggcggaagtggaggcggaggatctggcggcggaggctcttctgtgctgacccagcctagctccgtgtctgctgctcctggacagaaagtgaccatctcctgtagcggcagcaccagcaacatcggcaacaactacgtgtcctggtatcagcagcaccccggcaaggcccctaagctgatgatctacgacgtgtccaagaggcccagcggcgtgccagatagattttccggcagcaagagcggcaacagcgccagcctggatattagcggactccagtctgaggacgaggccgactactattgcgccgcctgggatgatagcctgagcgagtttctgtttggcaccggcaccaagctgacagtgcttggaacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3677 - DNA, 1731 bp, Artificial Sequence
  Synthetic Polynucleotide encoding a Bispecific antibody
atggccttaccagtgaccgccttgctcctgccgctggccttgctgctccacgccgccaggccggacatccagatgacacagagccctagcagcctgtctgccagcgtgggagacagagtgaccatcacctgtagaaccagccagagcctgagcagctacacccactggtatcagcagaagcctggcaaggcccctaagctgctgatctatgccgcttccagcagaggcagcggagtgcctagcagattttctggcagcggctccggcaccgatttcaccctgacaatatccagcctccagcctgaggacttcgccacctactactgccagcagagcagaacattcggccagggcaccaaggtggaaatcaaaggcggaggcggaagtggaggcggaggatctggcggcggaggctctcaagttcagctccagcagtctggccctggcctggttaagcctagccagacactgagcctgacctgtgccatcagcggcgatagcgtgtccagctacaacgccgtgtggaactggatcagacagagcccatccagaggactggaatggctgggcagaacctactacagaagcggctggtacaacgactacgccgagagcgtgaagtcccggatcaccatcaatcccgacaccagcaagaaccagttcagcctgcaactgaacagcgtgacccctgaggataccgccgtgtactactgtgctagaagcggccacatcaccgtgttcggcgtgaacgtggacgccttcgatatgtggggccagggaacaatggtcaccgtgtctagtacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3678 - DNA, 1728 bp, Artificial Sequence
  Synthetic Polynucleotide encoding a Bispecific antibody
atggccttaccagtgaccgccttgctcctgccgctggccttgctgctccacgccgccaggccggacatcgtgctgacccagagccctctgagcctggccgtgtctctgggacagcctgccatcatcagctgcaaggccagccagagcgtgtcctttgccggcacctctctgatgcactggtatcaccagaagcccggccagcagcccagactgctgatctacagagccagcaacctggaagccggcgtgcccgatagattttccggcagcggcagcaagaccgacttcaccctgaccatcagccccgtggaagccgaagatgccgccacctactactgccagcagagcagagagtacccctacaccttcggcggaggcaccaagctggaaatcaagaggggcggaggcggaagtggaggcggaggatctggcggcggaggctctcaggtccaactggtgcagagcggagccgaggtcgtgaagcctggcgcttccgtgaagattagctgcaaagccagcggctacacctttaccggctactttatgaactgggtcaagcagagccctggccagagcctggaatggatcggcagaatccacccctacgacggcgacaccttctacaaccagaagttccagggcaaggccaccctgacagtggacaagagcagcaacaccgcccacatggaactgctgagcctgaccagcgaggacttcgccgtgtactactgcaccagatacgacggcagccgggctatggactattggggccagggcaccaccgtgaccgtgtctagtacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3679 - DNA, 1647 bp, Artificial Sequence
  Synthetic Polynucleotide encoding a Bispecific antibody
atggccttaccagtgaccgccttgctcctgccgctggccttgctgctccacgccgccaggccgaacagctgcgagctgaccaacatcacaatcgccatcgagaaagaggaatgccggttctgcatcagcatcaacaccacttggtgcgccggctactgctacacccgcgatctggtgtataaggaccccgccagacctaagatccagaaaacctgcaccttcaaagagctggtctacgagacagtcagagtgcctggatgtgcccaccacgccgatagcctgtacacataccctgtggctacccagtgccactgcggcaagtgtgatagcgacagcaccgattgcaccgtcagaggactgggacccagctactgtagcttcggcgagatgaaggaaggcggaggcggaagtggaggcggaggatctggcggcggaggctctgctcctgatgtgcaggattgccctgagtgcaccctgcaagagaaccccttcttctcccaacctggcgctcctatcctccagtgcatgggctgctgcttcagccgggcttatcccacacctctgcggagcaagaaaaccatgctggtccagaaaaacgtgaccagcgagagcacctgttgtgtggctaagagctacaacagagtgaccgtgatgggcggcttcaaggtggaaaatcacaccgcctgccactgctccacctgttactaccacaagagcacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3680 - DNA, 1740 bp, Artificial Sequence
  Synthetic Polynucleotide encoding a Bispecific antibody
atggccttaccagtgaccgccttgctcctgccgctggccttgctgctccacgccgccaggccggacctggaaaccaccctgacacagagccctgccaccctgagtgtgtccccaggcgagagagtgaccctgagctgtagagccagccagagcgtgggcagcaacctggcctggtatcagcagaagttcggccaggcccccagactgctgatctacgacgccagcacaagagccaccggcatccccgccagattttctggcagcggctccggcaccgagttcaccctgaccatcagcagactggaacccgaggacttcgccgtgtactactgccaccagtacggcagcagccccagaacctttggacagggcaccaaggtggacatcaagcggggcggaggcggaagtggaggcggaggatctggcggcggaggctctcaggtgcaactggtgcagagcggagccgaagtgaagaaacctggggccagcgtgaaggtgtcctgcaaggccagcggctacacctttaccacctacggcatctcttgggtgcgccaggctcctggacagggactggaatggatgggctggatcagcgcctacaacggccacaccaactacgcccagatgctccagggcagagtgaccatgaccaccgacaccagcacctccaccgcctacatggaactgcggggcctgagaagcgacgacaccgccgtgtattattgcgccagagaagcctacgcctcctacggcagcggcagctactggaccgattattggggccagggcaccctcgtgaccgtgtctagtacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3681 - DNA, 1719 bp, Artificial Sequence
  Synthetic Polynucleotide encoding a Bispecific antibody
atggccttaccagtgaccgccttgctcctgccgctggccttgctgctccacgccgccaggccggacgacgttgtgatgacccagacccccctgagcctgcctgtgacacctggcgaacctgccagcatcagctgtcggagcagccagagcctggtgcacagaaacggcaacacctacctgcactggtatctccagaagcccggccagagccccaagctgctgatccacaaggtgtccaacagattcagcggcgtgcccgacagattctccggcagcggctctggcaccgacttcaccctgaagatcagccgggtggaagccgaggacctgggcgtgtacttctgtagccagagcacccatgtgccccccctgacatttggagccggcaccaagctggaactgaagggcggaggcggaagtggaggcggaggatctggcggcggaggctctgaagtgcagctggtgcagtctggcgctgaggtggaaaagcctggggccagcgtgaagattagctgcaaggccagcggcagcagcttcaccggctacaacatgaactgggtgcgccagaacatcggcaagagcctggaatggatcggagccatcgacccctactacggcggcaccagctacaaccagaagttcaagggcagagccaccctgaccgtggacaagagcaccagcaccgcctacatgcacctgaagtccctgcggagcgaggacaccgccgtgtactactgtgtgtccggcatggaatattggggccagggcaccagcgtgaccgtgtctagtacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3682 - DNA, 1713 bp, Artificial Sequence
  Synthetic Polynucleotide encoding a Bispecific antibody
atggccttaccagtgaccgccttgctcctgccgctggccttgctgctccacgccgccaggccggacgagatcgtgatgacccagacccctgccaccctgtctgtgtctgccggcgagagagtgaccattacctgcaaggccagccagagcgtgtccaacgacgtgacctggtatcagcagaagcccggccaggcccccagactgctgatctacagcgccagcaacagatacagcggcgtgcccgccagattttccggcagcggctacggcaccgagttcaccttcaccatcagcagcgtgcagagcgaggacttcgccgtgtacttctgtcagcaagactacagcagcttcggccagggcaccaagctggaaatcaagaggggcggaggcggaagtggaggcggaggatctggcggcggaggctctcaggtgcagctggtggaatctggacctggcgtggtgcagcctggcagaagcctgagaatcagctgtgccgtgtccggcttcagcgtgaccaactacggcgtgcactgggtgcgccagccacctggaaaaggactggaatggctgggcgtgatctgggctggcggcatcaccaactacaacagcgccttcatgtcccggctgaccatctccaaggacaacagcaagaacaccgtgtacctccagatgaacagcctgcgggccgaggacaccgccatgtactactgtgcttccagaggcggccactacggctacgccctggattattggggccagggaaccctcgtgaccgtgtcctctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3683 - DNA, 1719 bp, Artificial Sequence
  Synthetic Polynucleotide encoding a Bispecific antibody
atggccttaccagtgaccgccttgctcctgccgctggccttgctgctccacgccgccaggccggacatccagatgacccagaccgccagcagcctgcctgcctctctgggcgacagagtgaccatctcctgtagcgccagccaggacatcagcaactacctgaactggtatcagcagaaacccgacggcaccgtgaagctgctgatcttctacagcagcaacctgcacagcggcgtgcccagcagattttctggcggcggaagcggcaccgactacagcctgaccatcagcaatctggaacccgaggacattgccacctacttttgccaccagtacagcaagctgccctggacctttggcggaggcaccaagctggaaatcaagagaggcggaggcggaagtggaggcggaggatctggcggcggaggctctgaagtgaccctggtggaaagcggcggagacttcgtgaagcctggcggctctctgaaggtgtcctgtgccgccagcggcttcgcctttagccactacgccatgagctgggtgcgccagacccctgccaagagactggaatgggtggcctacatcagcagcggcggctccggcacctactactccgatagcgtgaagggccggttcaccatcagccgggacaacgccaagaacaccctgtacctccagatgcggagcctgcggagcgaggacagcgccatgtatttctgcaccagagtgaagctgggcacctattacttcgactcttggggccagggcaccaccctgaccgtgtcatctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3684 - DNA, 1725 bp, Artificial Sequence
  Synthetic Polynucleotide encoding a Bispecific antibody
atggccttaccagtgaccgccttgctcctgccgctggccttgctgctccacgccgccaggccgcagttcgtgctgacccagagcccttctgcctctgctgccctgggagcctctgccaagctgacctgtacactgagcagcgcccacaagacctacaccatcgactggtatcagcagcagaagggaaaggcccccagatacctgatccaagtgaagtccgacggcacctacacaaaggccaccggcgtgcccgatagattcagcggcagtagcagcggagccgatagatacctgattatccccagcgtgcaggccgacgacgaggccgattactactgcggcaccgattacaccggcggctacgtgttcggcggaggcacacaactgaccgtgacaggcggaggcggaagtggaggcggaggatctggcggcggaggctctgagcaactgaaagagtctggcggcggactgttcaagcccaccgataccctgaccctgacctgcaccgtgtccggcttcagcctgagctactacggcgtgaactgggtgcgccaggcccctggcaatggcctggaatggatcggcacaatcggcggcagcggcgacacctactatgcctcttgggccaagtccagaagcaccatcatcagaaacaccaacgagaacaccgtgaccctgaagatgaccagcctgacagccgccgacaccgccacctacttttgcgtcagatacgccaacatcggctacgagtatttcaacgtgtggggacccggcaccctcgtgaccgtgtcatctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3685 - DNA, 1740 bp, Artificial Sequence
  Synthetic Polynucleotide encoding a Bispecific antibody
atggccttaccagtgaccgccttgctcctgccgctggccttgctgctccacgccgccaggccgcagttcgtgctgacccagagcccttctgtgtctgccgccctgggagcctctgccaagctgacctgtacactgagcagcgcccacaagacctacaccatcgactggtatcagcagcagcagggcgaggcccccagatacctgatgcaagtgaagtccgacggcagctacaccaagggcaccggcgtgcccgatagattcagcggcagtagcagcggagccgatagatacctgattatccccagcgtgcaggccgacgacgaggccggatatgtgtgcggcgctgacgacaatggcggctacgtgttcggcggaggcacccaactgacagtgacaggcggaggcggaagtggaggcggaggatctggcggcggaggctctcagagcgtgaaagagtctgagggcggcctgttcaagcccaccgataccctgaccctgacctgcaccgtgtccggcttcagcctgagcagacacgccctgacatgggtgcgccaggcccctggaaatggcctggaatggatcggagccatcgacaacgccggcaccacctactatgcctcttgggccaagtccagaagcaccatcacccggaacaccgacctgcacaccgtgaccctgaagatgaccagcctgaccgccagcgacaccgccacctacttttgcgccagagtgttctacgacatcaacagcggctactacctggacggcatggacctgtggggacctggcacacttgtgaccgtgtccagcacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3686 - DNA, 1722 bp, Artificial Sequence
  Synthetic Polynucleotide encoding a Bispecific antibody
atggccttaccagtgaccgccttgctcctgccgctggccttgctgctccacgccgccaggccggacatccagatgacccagagccccagcagcctgtctgccagcgtgggcgacagagtgaccatcacctgtagagccagccagggcatcagctcttggctggcctggtatcagcagaagcccgagaaggcccccaagagcctgatctacgccgcctctagtctccagagcggcgtgcccagcagattttctggcagcggctccggcaccgacttcaccctgacaatcagctccctccagcccgaggacttcgccacctactactgccagcagtacaacagctacccccccacctttggcggaggcaccaaggtggaaatcaagggcggaggcggaagtggaggcggaggatctggcggcggaggctctgaagtgcaactggtggaatcaggcggcggactggtgcagcctggcgagtctctgagactgagctgtgtggcctccggcttcaccttcagccggtacaagatgaactgggtgcgccaggcccctggcaagggactggaatgggtgtcctacatcagccgcagcggcagagacatctactacgccgacagcgtgaagggccggttcaccatcagcagagacaacgccaagaacagcctgtacctccagatgaactccctgcgggacgaggacaccgccgtgtactactgtgccggaaccgtgaccacctattactacttcggcatggacgtgtggggccacggcaccaccgtgacagtgtcatctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3687 - DNA, 1725 bp, Artificial Sequence
  Synthetic Polynucleotide encoding a Bispecific antibody
atggccttaccagtgaccgccttgctcctgccgctggccttgctgctccacgccgccaggccggacatccagatgacccagagccccagcagcctgtctgccagcgtgggcgacagagtgaccatcacctgtagagccagccagggcatcagctcttggctggcctggtatcagcagaagcccgagaaggcccccaagagcctgatctacgccgcctctagtctccagagcggcgtgcccagcagattttctggcagcggctccggcaccgacttcaccctgacaatcagctccctccagcccgaggacttcgccacctactactgccagcagtacaacagctaccctcccacctttggcggaggcaccaaggtggaaatcaagggcggaggcggaagtggaggcggaggatctggcggcggaggctctgaagtgcaactggtggaatccgggggaggctctgtgcagcctggcgagtctctgagactgagctgtgtggcctccggcttcaccttcagccggtacaagatgaactgggtgcgccaggcccctggcaagggactggaatgggtgtcctacatcagccgcagcggcagagacatctactacgccgacagcgtgaagggccggttcaccatcagcagagacaacgccaagaacagcctgtacctccagatgaactccctgcgggacgaggacaccgccgtgtactactgtgccggaaccgtgaccacctattactacgacttcggcatggacgtgtggggccagggcacaaccgtgacagtgtctagcacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3688 - DNA, 1722 bp, Artificial Sequence
  Synthetic Polynucleotide encoding a Bispecific antibody
atggccttaccagtgaccgccttgctcctgccgctggccttgctgctccacgccgccaggccgcagtctgtgctgacacagcctccatctgcctctggcacacctggacagagagtgaccatcagctgtagcggcagcagaagcaacgtcggcggcaactacgtgttctggtatcagcaggtcccaggcgctacccctaagctgctgatctacagaagcaatcagcggcctagcggcgtgcccgatagatttgccggaagcaagagcggcagctctgccagccttgccatctctggactgagaagcgaggacgaggccgactactactgtgccacctgggatgatagcctgagcggcttcgtgtttggcaccggcaccaaagtgacagtgcttggtggcggaggcggaagtggaggcggaggatctggcggcggaggctctgaagttcagctggttgaatctggcggcggactggttaagcctggcggatctctgagactgtcttgtgccgccagcggcttcaccttcagcgattactacatgagctggatcagacaggcccctggcaaaggactggaatgggtgtcctacatcagcagcagcggctccaccatctactacgccgatagcgtgaagggcagattcaccatcagccgggacaacgccaagaacagcctgtacctccagatgaactccctgagagccgaggacaccgccgtgtactattgcgccagaggctacggcaaagcctacgatcaatggggccagggcacactggtcaccgtttcttctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3689 - DNA, 1719 bp, Artificial Sequence
  Synthetic Polynucleotide encoding a Bispecific antibody
atggccttaccagtgaccgccttgctcctgccgctggccttgctgctccacgccgccaggccgcagtctgtggtcacacagccacctagcatgtctgccgctccaggccagcaagtgaccatctcttgtagcggcggcaacagcaacatcgagcggaactacgtgtcctggtatctgcaactgcctggcacagcccctaagctggtcatcttcgacaacgacagacggcccagcggcatccccgatagattttctggcagcaagagcggcaccagcgccacactgggaattaccggacttcagacaggcgacgaggccgactactactgtggcacatgggactctagcctgagaggctgggttttcggcggaggcacaaagctgacagtgcttggtggcggaggcggaagtggaggcggaggatctggcggcggaggctctgaagtgcagctcgttgagtctggcggcggactgattcaacctggcggaagcctgagactgagctgtgccgcttccggcttcaccttcagcaactacgccatgaactgggttcgacaggcccctggcaaaggactggaatgggtgtccaccatcaacggcagaggcagcagcaccatctacgccgattctgtgaagggcagattcaccatcagccgggacaacagcaagaacaccctgtacctccagatgaactccctgagagccgaggacaccgccacctattactgtgcccggtacatcagcagaggactgggcgattcttggggccagggcacactggttacagtgacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3690 - DNA, 1719 bp, Artificial Sequence
  Synthetic Polynucleotide encoding a Bispecific antibody
atggccttaccagtgaccgccttgctcctgccgctggccttgctgctccacgccgccaggccgcagtctgtggtcacacagcctccatctgtgtctggcgctccaggccagagagtgaccatctcttgtaccggcagcagcagcaatatcggagccggctatgacgtgcactggtatcagcagctccctggcacagcccctaaactgctgatctacggcaacagcaacagacccagcggcgtgcccgatagattttccggctctaagagcggcacaagcgccagcctggctattactggactccaggccgaggacgaggccgactactactgtcagagctacgacagcagcctgagcggcagctatgtgtttggcaccggcaccaagctgacagtgcttggaggcggaggcggaagtggaggcggaggatctggcggcggaggctctgaagttcaactggtggaaaccggcggcaacctggttcaacctggcgcttctctgagactgagctgtgccgccagcggctttagctttagcggaacagccatgcactgggtccgacaggcacctggcaaaggactggaatgggtgtccaccatcagcagcacaggcagaagcacctactaccgggacagcgtgaagggcagattcaccatctccagagacaacagcaagaacaccctgtacctccagatgaacagcctgagaggcgaggacaccgccgtgtactattgtgccagagtgtccttcgactactggggccagggaaccctggtcacagtctcttctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3691 - DNA, 1725 bp, Artificial Sequence
  Synthetic Polynucleotide encoding a Bispecific antibody
atggccttaccagtgaccgccttgctcctgccgctggccttgctgctccacgccgccaggccgcagtctgtggttacacagcctgcctccgtgtctggctctcctggccagagcatcaccatcagctgtaccggcaccagctctgatgtcggcggctacaattacgtgtcctggtatcagcagcaccccggcaaggcccctaagctgatgatctacgacgtgtccaagaggcccagcggcgtgtccaatagattcagcggcagcaagagcggcaacaccgccagcctgacaatttctggactgcaagccgaggacgaggccgactactactgtagcagctacaccagcagcagcacactggtgtttggcggaggcaccaagctgacagttcttggaggcggaggcggaagtggaggcggaggatctggcggcggaggctctgaagttcagctggttgaaagcggcggagcctttgttcagcctggcggatctctgagactgagctgtgccgccagcggcttcacattttccagctacgccatgacctgggtccgacaggctcctggcaaaggactggaatgggtgtccaccatctccggcagaggcagaagcaccttctacgccgatagcgtgaagggcagattcacaatcagccgggacaacagcaagaacaccctgtacctccagatgaacagcctgagagccgaggataccgccgtgtactactgtgcccggtactatcacgctggcgcctttgatctttggggccagggaacactggtcaccgtgtcatctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3692 - DNA, 1719 bp, Artificial Sequence
  Synthetic Polynucleotide encoding a Bispecific antibody
atggccttaccagtgaccgccttgctcctgccgctggccttgctgctccacgccgccaggccggacaacatcgagctgacccagagccccgccatcatgagtgcctctccaggcgagcgcgtgaccatgacatgtagcgccagcagcagcatccggtacatctactggtatcagcagaagcccggcagcagccccagactgctgatctacgacaccagcaacgtggcccctggcgtgccctttagattttccggcagcggctccggcaccagctacagcctgaccatcaaccggatggaagccgaggacgccgccacctactattgtcaggaatggagcggctacccctacaccttcggcggaggcaccaagctggacatcaagagaggcggaggcggaagtggaggcggaggatctggcggcggaggctctcaagtgaagctccaggaatctggcggcggactcgtgaagcctggcggctctctgaagctgagctgtgccgccagcggcttcaccttcagcagctacggcatgagctgggtgcgccagacccccgacaagagactggaatgggtggcaaccatcagcagcggcggcagctacacctactaccccgatagcgtgaagggccggttcaccatctccagagacaacgccaagaacaccctgtacctccagatgagcagcctgaagtccgaggataccgccatgtactactgcgccagaggcaactgggagggctggtacttcgatgtgtggggccagggcaccaccgtgaccgtgtcatctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3693 - DNA, 1749 bp, Artificial Sequence
  Synthetic Polynucleotide encoding a Bispecific antibody
atggccttaccagtgaccgccttgctcctgccgctggccttgctgctccacgccgccaggccggacaacttcatgctgacccagccccacagcgtgtccgagagccctggcaagaccgtgaccatctcctgtaccggcagcggcggcagcatcgacaacaactacgtgcactggtatcagcagaggcccggcagcgcccctaccaccgtgatgttcgaggacaaccagaggcccagcggcgtgcccgatagattcagcggctctatcgacagcagcagcaacagcgccagcctcgtgatctccggcctgaaaaccgaggacgagggcgactactactgccagagcagcgacggctccaaggtggtgtttggcggaggcaccaagctgaccgtgctgggacagggcggaggcggaagtggaggcggaggatctggcggcggaggctctgaagtgcaactggtgcagagcggcggaggctctctgacactgtcttgtgctgcctccggcgtggtgcagcctggcagattcaccttcagcagctacggaatgcactgggtgcgccaggcccctggaaagggactggaatgggtgtccgtgatctcttacgacggcagcaacaagtattacgccgacagcgtgaagggccggttcaccatctccagagacaacagcaagaacaccctgtacctccagatgaacagcctgcggaccgaggacaccgccgtgtactactgtgccaagaccctgtccgctggcgagtggattggaggcggagccttcgatatctggggccacggcacaatggtcaccgtgtcctctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3694 - DNA, 1719 bp, Artificial Sequence
  Synthetic Polynucleotide encoding a Bispecific antibody
atggccttaccagtgaccgccttgctcctgccgctggccttgctgctccacgccgccaggccggacgtcgtgatgacccagacccctctgagcctgcctgtgtccctgggcgatcaggccagcatcagctgtagaagcagccagagcctggtgcacagcaacggcaacacctacctgcactggtatctccagaagcccggccagagccccaagctgctgatctacaaggtgtccaacagattcagcggcgtgcccgacagattctccggcagcggctctggcaccgacttcaccctgaagatcagccgggtggaagccgaggacctgggcgtgtacttctgtagccagaacacccccgtgccccccaagtttggcagcggcaccaagctggaaatcaagggcggaggcggaagtggaggcggaggatctggcggcggaggctctcaggtgcagctccagcagtctggcgctgaactcgtgcggcctggcgcttctgtgaagctgtcttgcaaggccagcggctacaccttcaacgactacgagatgcactgggtcaagcagacccctgtgcacggcctgaagtggatcggagccctggaacccaagaccggcgataccgcctacagccagaagttcaagggcaaggccaccctgaccgccgacaagagcagcagcacagcctacatggaactgcggagcctgaccagcgaggacagcgccgtgtactactgcaccagctgctactactacacctacagcggccagggcaccctcgtgacagtgtctgctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3695 - DNA, 1716 bp, Artificial Sequence
  Synthetic Polynucleotide encoding a Bispecific antibody
atggccttaccagtgaccgccttgctcctgccgctggccttgctgctccacgccgccaggccggacatccaactgacccagagccccagcagcctgtctgcctctgtgggcgacagagtgaccatcacctgtagagccagccagggcatcagaaacgacctgggctggtatcagcagaagcccggcaaggcccccaagcggctgatctatgctgccagctccctccagaatggcgtgcccagcagattttccggcagcggctctggcaccgagttcaccctgaccatcagctccctccagcccgaggacttcgccacctactactgcctccagcacaacacctaccccgccttcggccagggcaccaaggtggaaatcaagagaggcggaggcggaagtggaggcggaggatctggcggcggaggctctcaggtgcaactccaggaatctggccctggcctcgtgaagcctagccagaccctgagcctgacctgtaccgtgtctggcggcagcatcagcagcttcaactactactggtcctggatcagacaccaccctggcaagggcctggaatggatcggctacatctactacagcggcagcacctacagcaaccccagcctgaagtcccgcgtgaccatctccgtggacaccagcaagaaccagtttagcctgaccctgtccagcgtgacagccgccgataccgccgtgtactactgcgccagaggctacaactggaactacttcgactactggggccagggaaccctcgtgaccgtgtctagtacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3696 - DNA, 1722 bp, Artificial Sequence
  Synthetic Polynucleotide encoding a Bispecific antibody
atggccttaccagtgaccgccttgctcctgccgctggccttgctgctccacgccgccaggccggacgacatcgtgctgacccagagccccgccagcctggccgtgagcctgggccagagcgtgaccatcagctgcagagccagcgagagcgtggagtactacggcaccagcctgatgcagtggtaccagcagaagcccggccagccccccaagctgctgatctacgccaccagcaacgtggagagcggcgtgcccgccagattcagcggcagcggcagcggcaccgacttcagcctgaacatccaccccgtggaggaggacgacatcgccatgtacttctgccagcagagcagaaagctgcccagcaccttcggcggcggcaccaagctggagatcaagggcggaggcggaagtggaggcggaggatctggcggcggaggctctgacgtgagactgcaggagagcggccccggccaggtgaagcccagccagaccgtgagcctgacctgcagcgtgaccggctacagcatcaccaacggcaaccactggtggaactggatcagacaggtgagcggcagcaagctggagtggatcggctacatcagcagcagcggcagcaccgacagcaaccccagcctgaagagcagaatcagcatcaccagagacaccagcaagaaccagctgttcctgcagctgaacagcgtgaccaccgaggacatcgccacctactactgcgccagaggctactacttcgactactggggccagggcaccaccctgaccgtgagcagcacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3697 - DNA, 1356 bp, Artificial Sequence
  Synthetic Polynucleotide encoding a Bispecific antibody
atggccctgcccgtgacagccctgctgctgcctctggctctgctgctgcacgccgccagacccgatgaattcgaggtgcaactggtggaaagcggcggaggcctggtgcaggctggcggatctctgagactgagctgtgccgccagcggcatcaccttcagcatcaacacaatgggctggtacagacaggcccctggcaagcagagggaactggtggccctgatctccagcatcggcgacacctactacgccgacagcgtgaagggccggttcaccatcagccgggacaacgccaagaacaccgtgtacctccagatgaacagcctgaagcccgaggacaccgccgtgtactactgcaagcggttcagaacagccgcccagggcaccgattattggggccagggaacacaagtgaccgtgtcctctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3698 - DNA, 1161 bp, Artificial Sequence
  Synthetic Polynucleotide encoding a Bispecific antibody
atggactggatttggcgcatccttttccttgtcggcgctgctaccggcgcccattccttcgaaggcagcggattcgaatacgccaaagagatgcggaacgcctactgggagatcgccctgctgcccaatctgaccaaccagcagaagagagcccccatcagaaagctgtacgacgacccctcccagagcagcgagctgctgtctgaggctaaaaaactgaacgatagccagacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3699 - DNA, 1374 bp, Artificial Sequence
  Synthetic Polynucleotide encoding a Bispecific antibody
atggccctgcccgtgacagccctgctgctgcctctggctctgctgctgcacgccgccagacccgatgaattcggctctgacctgggcatcaagctgctgttcgccgctgccaagggccaggacgacgaagtgcggattctgctggctgctggggccgacgtgaacgccaaggatttcgagggctacacccccctgcacgtggccgcctatgatggacacctggaaatcgtggaagtgctgctgaaggctggcgctgatgtgaatgccaaagacagccagggccggacccctctgcatgaagccgcctacagcggccatctggaaattgtggaagtgctgctgaaagccggggcagacgtgaacgctcaggacgacgctggcgagacaccagccgatctggctgcagcttggggccacgaagatatcgccgaggtgctgcagaagacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3700 - DNA, 1371 bp, Artificial Sequence
  Synthetic Polynucleotide encoding a Bispecific antibody
atggactggatttggcgcatccttttccttgtcggcgctgctaccggcgcccattccttcgaaagaagcgatctgggaaagaagctgctggaagctgccagagccggacaggatgatgaagtgcgcatcctgatggcaaacggcgcagatgtgaacgcaaaggacgagtacggcctgacccccctgtacctggctacagcccacgggcacctggaaattgtggaagtgctgctgaagaacggcgctgacgtgaacgccgtggacgccatcggctttaccccactgcatctggccgctttcatcgggcatctcgaaatcgcagaggtgctgctgaaacacggggccgatgtgaatgcccaggacaagttcggcaagaccgccttcgacatcagcatcggcaacggcaacgaggacctggccgagatcctgcagaaactgaacacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3701 - DNA, 1827 bp, Artificial Sequence
  Synthetic Polynucleotide encoding a Bispecific antibody
atggccctgcccgtgacagccctgctgctgcctctggctctgctgctgcacgccgccagacccgatgaattcgaggtgcaactggtggaaagcggcggaggcctggtgcaggctggcggatctctgagactgagctgtgccgccagcggcatcaccttcagcatcaacacaatgggctggtacagacaggcccctggcaagcagagggaactggtggccctgatctccagcatcggcgacacctactacgccgacagcgtgaagggccggttcaccatcagccgggacaacgccaagaacaccgtgtacctccagatgaacagcctgaagcccgaggacaccgccgtgtactactgcaagcggttcagaacagccgcccagggcaccgattattggggccagggaacacaagtgaccgtgtcctctctcgagggaggaggcggctccgggggaggcggaagtggaggcggaggatctgggtctggaggaagcggatctggaggctcagggtcagggggctcaggcagtggaggctctttcgaagtgcaactggtggaatctgggggcggactggtgcagccaggcggaagtctgaggctgtcttgtgccgcctccggcagcatcttcggcttcaacgacatggcctggtatcggcaggctcccggaaaacagcgcgagctggtggctctgattagcagagtgggcgtgaccagcagcgccgactctgtgaagggcagattcacaatctccagagtgaacgccaaggatacagtgtacctccagatgaactctctgaaacctgaggatacagcagtgtactattgctacatggaccagcggctggacggcagcacactggcctactggggacagggaactcaagtgacagtgtctagcacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3702 - DNA, 1719 bp, Artificial Sequence
  Synthetic Polynucleotide encoding a Bispecific antibody
atggccttaccagtgaccgccttgctcctgccgctggccttgctgctccacgccgccaggccggacatccagatgacccagagccccagcagcctgtctgccagcgtgggcgacagagtgaccatcacctgtagagccagccaggacgtgaacaccgccgtggcctggtatcagcagaagcctggcaaggcccccaagctgctgatctacagcgccagcttcctggaaagcggcgtgcccagcagattcagcggaagcagaagcggcaccgacttcaccctgaccatcagctccctccagcccgaggacttcgccacctactactgccagcagcactacaccacccctcccaccttcggccagaccaaggtggaaatcaagagaggcggaggcggaagtggaggcggaggatctggcggcggaggctctgaagtgcaactggtggaatctggcggcggactggtgcagcctggcggatctctgagactgagctgtgccgccagcggcttcaacatcaaggacacctacatccactgggtgcgccaggcccctggaaagggactggaatgggtggcccggatctaccccaccaacggctacaccagatacgccgacagcgtgaagggccggttcaccatcagcgccgacaccagcaagaataccgcctacctccagatgaacagcctgcgggccgaggataccgccgtgtactactgctcaagatggggaggcgacggcttctacgctatggacgtgtggggccagggcacccttgtgaccgtgtcatctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3703 - DNA, 1356 bp, Artificial Sequence
  Synthetic Polynucleotide encoding a Bispecific antibody
atggccctgcccgtgacagccctgctgctgcctctggctctgctgctgcacgccgccagacccgatgaattcgacgtgcaactcgtggaatccggcggaggcctggtgcagcctggcggatctctgagactgagctgtgccgccagcggctctatcggcggactgaatgccatggcctggtacagacaggcccctggcaaagaacgggaactggtggccggcatctttggcgtgggcagcaccagatacgccgacagcgtgaagggccggttcaccatcagccgggacaacagcaagaacaccgtgtacctgcagatgaacagcctgcggcccgaggataccgccgtgtactactgcagaatgtccagcgtgaccagaggctccagcgactactggggccagggaacacttgtgaccgtgtccagtacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3704 - DNA, 1176 bp, Artificial Sequence
  Synthetic Polynucleotide encoding a Bispecific antibody
atggccctgcccgtgacagccctgctgctgcctctggctctgctgctgcacgccgccagacccgatgaattcgtggacaacaagttcaacaaagagcggtacagcgcctactacgagatttggcaactgcccaacctgaacgtgcggcagaaggccgccttcatcggatctctgcaggacgaccctagccagagcgccaatctgctggccgaggccaagaagctgaacgacgcccaggcccctaaaacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3705 - DNA, 1842 bp, Artificial Sequence
  Synthetic Polynucleotide encoding a Bispecific antibody
atggccctgcccgtgacagccctgctgctgcctctggctctgctgctgcacgccgccagacccgatgaattcgacgtgcaactcgtggaatccggcggaggcctggtgcagcctggcggatctctgagactgagctgtgccgccagcggctctatcggcggactgaatgccatggcctggtacagacaggcccctggcaaagaacgggaactggtggccggcatctttggcgtgggcagcaccagatacgccgacagcgtgaagggccggttcaccatcagccgggacaacagcaagaacaccgtgtacctgcagatgaacagcctgcggcccgaggataccgccgtgtactactgcagaatgtccagcgtgaccagaggctccagcgactactggggccagggaacacttgtgaccgtgtccagtctcgagggaggaggcggctccgggggaggcggaagtggaggcggaggatctgggtctggaggaagcggatctggaggctcagggtcagggggctcaggcagtggaggctctttcgaagtgcaactggtggaatctggaggctctctggtgcagccagggggaagcctgagactgtcttgtgccgcttccggcttcaccttcgacgactacgccatgagctgggtgcgccaggtgccaggcaaaggcctggaatgggtgtccagcatcaactggagcggcacccacaccgattacgccgactccgtgaaaggcagattcacaatcagcagaaacaacgccaacaataccctgtacctgcagatgaactccctgaagtctgaggatacagcagtgtattattgcgccaagaactggcgggacgccggcaccacttggtttgagaaaagcggctctgccggacagggaacccaagtgacagtgtcctccacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3706 - DNA, 1716 bp, Artificial Sequence
  Synthetic Polynucleotide encoding a Bispecific antibody
atggccttaccagtgaccgccttgctcctgccgctggccttgctgctccacgccgccaggccggaccagagcgtgctgacacagcctcctagcgtgtcagtggcccctggcaagaccgccagaatcccctgcgagggcaactacatcggcagcagcaacgtgcactggtatcagcagaagcccggccaggctcccgtgctcgtgatccacttcgacagcgacagacccagcggcatccccgacagattcagcggcagcaacagcggcaacatggctaccctgaccatcagcagagtggaagccggggacgaggccgactactactgtcaagtgtgggagaaccacggctgggtgttcggcggaggcaccaagctgacagtgctgtctggcggaggcggaagtggaggcggaggatctggcggcggaggctctgaggtgcaactggtggaaacaggcggcggactggtgcagcctggcgagtctctgagactgagctgtgccgccagcggcttcaccttcagcgactacgagatgaactgggtgcgccaggcccctggaaagggcctggaatgggtgtcctacatcagcagctccggcagcaccatctactacgccgacagcgtgaagggccggtttaccatctaccgggacaacgccaagaacagcctgtacctccagatgaactccctgcgggccgaggacaccgccctgtactattgtgccagagcctggggcgtgggaccccctgattattggggacagggcaccctcgtgaccgtgtcctctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3707 - DNA, 1740 bp, Artificial Sequence
  Synthetic Polynucleotide encoding a Bispecific antibody
atggccttaccagtgaccgccttgctcctgccgctggccttgctgctccacgccgccaggccggacatccagatgacccagagccccagcagcctgtctgccagcgtgggcgataccgtgaccatcacctgtcaggccaacggctacctgaactggtatcagcagcggagaggcaaggcccccaagctgctgatctacgacggcagcaagctggaaagaggcgtgcccagcagattcagcggcagaagatggggccaggagtacaacctgaccatcaacaacctccagcccgaggatattgccacatacttttgccaggtgtacgagttcgtggtgcccggcacacggctggacctgaagagaacagtggctgctcctggcggaggcggaagtggaggcggaggatctggcggcggaggctctcaggtgcagctgctccagtctggcgctgccgtgacaaagcctggcgcttctgtgcgggtgtcctgtgaagccagcggctacaacatccgggactacttcatccactggtggcggcaggctccaggccagggactccagtgggtgggatggatcaaccccaagaccggccagcccaacaaccccagacagttccagggcagagtgtccctgaccagacacgccagctgggacttcgacaccttcagcttctacatggatctgaaggccctgcggagcgacgataccgccgtgtacttctgcgccagacagagaagcgactactgggatttcgacgtgtggggcagcggcacccaagtgacagtgtctagcgccagcaccaagggacccacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3708 - DNA, 1758 bp, Artificial Sequence
  Synthetic Polynucleotide encoding a Bispecific antibody
atggccttaccagtgaccgccttgctcctgccgctggccttgctgctccacgccgccaggccgcagtctgccctgacacagcctcctagcgcctctggctctcccggccagagcatcaccatcagctgtaccggcaccagcaacaacttcgtgtcctggtatcagcagcacgccggcaaggcccccaagctcgtgatctacgacgtgaacaagcggcccagcggcgtgcccgatagattcagcggcagcaagagcggcaacaccgccagcctgacagtgtctggcctccagaccgatgacgaggccgtgtactactgcggcagcctcgtgggcaactgggacgtgatctttggcggaggcaccaagctgaccgtgctgggcggaggcggaagtggaggcggaggatctggcggcggaggctctcagccccagctccaggaatctggccccacactggtggaagccagcgagacactgagcctgacctgtgccgtgtccggcgattctaccgccgcctgcaatagcttctggggctgggtgcgccagcctcctggaaagggactggaatgggtgggaagcctgagccactgcgccagctattggaaccggggctggacctaccacaaccccagcctgaagtccagactgaccctggccctggacacccccaagaacctggtgttcctgaagctgaacagcgtgacagccgccgacaccgccacctactactgtgccagatttggcggcgaggtgctgcggtacaccgactggcctaaacctgcctgggtggacctgtggggcagaggaacactcgtgaccgtgtccagcacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3709 - DNA, 1713 bp, Artificial Sequence
  Synthetic Polynucleotide encoding a Bispecific antibody
atggccttaccagtgaccgccttgctcctgccgctggccttgctgctccacgccgccaggccggagatcgtgctgacacagagccctggcaccctgagcctgtctccaggcgagacagccatcatcagctgccggacaagccagtacggcagcctggcctggtatcagcagaggccaggacaggcccccagactcgtgatctacagcggcagcacaagagccgccggaatccccgatagattcagcggctccagatggggacccgactacaacctgaccatcagcaacctggaaagcggcgacttcggcgtgtactactgccagcagtacgagttcttcggccagggcaccaaggtgcaggtggacatcaaaagaggcggaggcggaagtggaggcggaggatctggcggcggaggctctcaggtgcagctggtgcagtctggcggccagatgaagaaacccggcgagagcatgagaatcagctgtcgggcctccggctacgagttcatcgactgcaccctgaactggatcagactggcccctggcaagcggcctgagtggatgggatggctgaagcctagaggcggagccgtgaactacgccagacctctccagggcagagtgaccatgaccagggacgtgtacagcgataccgccttcctggaactgcggagcctgaccgtggatgataccgccgtgtacttctgcaccagaggcaagaactgcgattacaactgggacttcgagcactggggcagaggcacccctgtgatcgtgtctagcacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3710 - DNA, 1743 bp, Artificial Sequence
  Synthetic Polynucleotide encoding a Bispecific antibody
atggccttaccagtgaccgccttgctcctgccgctggccttgctgctccacgccgccaggccggagctggtgctgacacagagccctggcaccctgtctctgtctgccggcgaaagagccaccctgagctgtagagccagccagagcgtgtcctctggcagcctggcttggtatcagcagaagccaggccaggcccccagactgctgatctacggcgcttctaccagagccaccggcatccccgatagattcagcggctctggctccggcaccgacttcaccctgacaatcggcagactggaacccgaggacctggccgtgtactactgccagcagtacggcaccagcccctacacattcggccagggcaccaagctggaaatcggcggaggcggaagtggaggcggaggatctggcggcggaggctctctggaacagagcggagccgaagtgaagaaacccggcagcagcgtgcaggtgtcctgcaaagcaagcggcggcaccttctctatgtacggcttcaactgggtgcgccaggctcctggacacggcctggaatggatgggcggcatcatccccatcttcggcacctccaactacgcccagaaattccggggcagagtgaccttcaccgccgaccaggccacaagcaccgcctacatggaactgaccaacctgcggagcgacgacaccgccgtgtattattgcgccagagacttcggccccgactgggaggatggcgacagctacgatggcagcggcagaggcttcttcgacttctggggccagggaacccttgtgaccgtgtcctcaacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3711 - DNA, 1731 bp, Artificial Sequence
  Synthetic Polynucleotide encoding a Bispecific antibody
atggccttaccagtgaccgccttgctcctgccgctggccttgctgctccacgccgccaggccggacgtggtcatgacacagagcccttctagcctgtctgccagcgtgggcgacagagtgacaatcacctgtcagagcagcctggacatcagccactacctgaactggtatcagcagaagcccggcaaggcccctaagctgctgatctacgacgccagcaatctggaaaccggcgtgcccagcagattttctggcagcggaagcggcacccacttcaccttcacaatatccagcctccagcctgaggacttcgccacctactactgccagcagtacgacaacctgcctctgacctttggcggaggcaccaagctggaaatcaagagaggcggaggcggaagtggaggcggaggatctggcggcggaggctctcaagttcaactggttcaatcaggcggaggcgtggtgcaacctggtggctctctgagagtgtcttgtgctgcctctggcgtgaccctgagcgactatggaatgcactgggtccgacaggcccctggcaaaggacttgagtgggtcgccttcatcagaaacgacggcagcgacaagtattacgccgacagcgtgaagggcagattcaccatcagccgggacaacagcgagaaaaccgtgtctctccagatgtctagcctgagagccgaggacaccgccgtgtactactgtgccaagaatggcgagagcggccctctggactactggtatctggatctgtggggcagaggcaccctggtcacagtctcttctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3712 - DNA, 1731 bp, Artificial Sequence
  Synthetic Polynucleotide encoding a Bispecific antibody
atggccttaccagtgaccgccttgctcctgccgctggccttgctgctccacgccgccaggccggacgacatcgtgatgacccagagccaggacagcatggctaccagcgtgggcgagcgcgtgaccgtgaattgcaaggccagccagaacgtggacaccaacgtggcctggtatcagcagaagcccggccagtctcctgagcccctgctgttcagcgccagctacagatacaccggcgtgcccgacagattcagcggcagcggctctggcaccgacttcaccctgacaatcagcagcgtgcaggccgaggacgtggccgagtatttctgccagcagtacaacagctaccccctgaccttcggccagggcaccaagctggaaatcaagagaggcggaggcggaagtggaggcggaggatctggcggcggaggctctgaagtgcaggtggaagtgtctggcggcggactggtgcagcctggcggatctatgagactgagctgtgccgtgtccggcttcaccttcagcaactactggatgaactgggtgcgccagtcccccgagaagggcctggaatggatcgccgagatccggctgaagtccaacaacttcgcccggtactacgccgagagcgtgaagggcagattcaccatcagccgggacaacagcaagaacagcctgtacctccagatgatctccctgagagccgaggacaccgccatctactactgcaccagctacggcaactacgtgggccactacttcgaccactggggccagggaacactgctgaccgtgtctagcacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3713 - DNA, 1743 bp, Artificial Sequence
  Synthetic Polynucleotide encoding a Bispecific antibody
atggccttaccagtgaccgccttgctcctgccgctggccttgctgctccacgccgccaggccgagctacgagctgacacagcctccatccgtgtctggcacacctggacagagagtggctatctcctgtagcggcagcagcagcaacatcggcaccagaatggtcacctggtatcagcacgtgccaggcacagcccctaagctgctgatcttcaacaacaaccagcggcctagcggcgtgcccgatagattttctgccagcaagagcggcacaagcgccagcctggctatcatcggactccagtctgacgacgaggccgactactactgtgccacctgggacgacaacgtgaagtcctacgtgttcggcaccggcaccaaagtgacagtgcttggaagtagaggcggaggcggaagtggaggcggaggatctggcggcggaggctctcttgaaatggcccaggttcagctccagcagtggggagctggactgctgaagcctagcgagacactgagcctgacctgtgctgtgtacggcggcagcttcagcggctactactggtcctggatcagacagcctcctggcaaaggactggaatggatcggcgagatcaaccacagcggctccaccaactacaaccccagcctgaagtccagagtgaccatcagcgtggacaccagcaagaaccagttctccctgaagctgagcagcgtgacagccgctgataccgccgtgtactattgcgctagagcccctcagtcttggtacgtgggagatgtgtggggccagggcacactggttacagtgtcatctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3714 - DNA, 1734 bp, Artificial Sequence
  Synthetic Polynucleotide encoding a Bispecific antibody
atggccttaccagtgaccgccttgctcctgccgctggccttgctgctccacgccgccaggccgcagtctgtgctgacacagcctcctagcctgtctgtggcccctggaaagacagccagcatcacatgcggcggcaacaacatcggcatgaagtccgtgcactggtatcagcagaggccaggacaggctcctgtgctggtcatctactacgacagcgacagaccctctggcatccccggcagattttccggcagcaactctggcaataccgccacactgaccatctccagagtggaagctggcgacgaggccgactactactgccaagtgtgggataccaccggcgatcaccctggctatgtgtttggcaccggcaccaaagtgacagtgcttggcggaggcggaagtggaggcggaggatctggcggcggaggctctcaagttcaactggttcagagcggagccgaagtgaagaaacctggcagcagcgtgaaggtgtcctgcaaagcaagcggcggcacctttagcagctacgccatctcttgggtccgacaggcacctggacaaggactggaatggatgggcggcatcatccccatcttcggcacagccaattacgcccagaaattccagggcagagtgaccatcaccgccgacgagtctacaagcaccgcctacatggaactgagcagcctgagaagcgaggacaccgccgtgtactattgtgccagaggcgtgtacggctacagcggctctgccccttatgatgagtggggccagggaaccctggtcaccgtttcttctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3715 - DNA, 1752 bp, Artificial Sequence
  Synthetic Polynucleotide encoding a Bispecific antibody
atggccttaccagtgaccgccttgctcctgccgctggccttgctgctccacgccgccaggccggacgagatcgtgctgacccagagccctctgagcctgcctgtgacacctggcgagcctgccagcatctcctgtagaagcagccagagcctgctgcacagcaacggctacaactacctggactggtatctccagaagcccggccagagcccccaactgctgatctacctgggcagcaacagagccagcggcgtgcccgatagattttccggcagcggctccggcaccgacttcaccctgaagatcagccgggtggaagccgaggacgtgggcgtgtactactgtatgcaggccctccagaccccccggacctttggacagggcaccaaggtggaaatcaagcggggcggaggcggaagtggaggcggaggatctggcggcggaggctctcaggtgcaactggtgcagtctggcggcggagtggtgcagcctggaagaagcctgagactgagctgtgccgccagcggcttcaccttcagcagctacggaatgcactgggtgcgccaggcccctggcaaaggactggaatgggtggccgtgatctcctacgacggctccaacaagtattacgccgacagcgtgaagggccggttcaccatctccagagacaacagcaagaacaccctgtacctccagatgaacagcctgcgggccgaggacaccgccgtgtactattgcgccagagacttcgactacggcgacagctactactactatggcatggacgtgtggggccagggcacaaccgtgaccgtgtcatctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3716 - DNA, 1734 bp, Artificial Sequence
  Synthetic Polynucleotide encoding a Bispecific antibody
atggccttaccagtgaccgccttgctcctgccgctggccttgctgctccacgccgccaggccggacgagatcgtgctgacacagagccctgccaccctgtctctgagccctggcgaaagagccaccctgagctgtagagccagccagagcgtgggcagctacctggcctggtatcagcagaagcctggcgctccccggctgctgatctacgatgcctctcacagagccaccggcatccccgccagattttctggcagcggctccggcaccgacttcaccctgacaatcagctccctggaacccgaggacttcgccgtgtactactgccagcagcggagcaactggccccccatgtataccttcggccagggcaccaagctggaaatcaagagaggcggaggcggaagtggaggcggaggatctggcggcggaggctctgaagtgcagctggtgcagtctggcgctgaggtgtccgtgaaggtgtcctgcaaagccagcggcggcaagaagcccggcagcacctttagcagctacaccatcagctgggtgcgccaggcacctggacagggcctggaatggatgggcggcatcatccccatcttcggcaccgccaactacgcccagaaattccagggcagagtgaccatcaccgccgacaagagcaccagcaccgcctacatggaactgagcagcctgcggagcgaggacacagccgtgtattattgtgccggcgacaccgacagcagcggctactatggcgctgtggactattggggccagggaaccctcgtgaccgtgtcctctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3717 - DNA, 1683 bp, Artificial Sequence
  Synthetic Polynucleotide encoding a Bispecific antibody
atggccttaccagtgaccgccttgctcctgccgctggccttgctgctccacgccgccaggccggacatccagatgacccagagccccagcagcctgtctgccagcgtgggcgacagagtgaccatcacctgtcaggccagccaggacatcaacaactacctgaactggtatcagcagaagcccggcaaggcccccaagctgctgatctacgacgccagcaatctgcagaccggcgtgcccagcagattttccggctctggcagcggcaccgacttcaccttcaccatcgaggacattgccacctactactgccagcagtacaccttcggccctggcaccaaggtggacatcaaaggcggaggcggaagtggaggcggaggatctggcggcggaggctctgaagtgcaactgctggaatctggcggcggactggtgcagcctggcggatctctgagactgagctgtgccgccagcggcttcacctttagctggtacagcatgacctgggtgcgccaggcccctggcaaaggactggaatgggtgtccagcatcgtgccctggggcgatttcacccagtacgccgatagcgtgaagggccggttcaccatcagccgggacaacagcaagaacaccctgtacctgcagatgaacagcctgcgggccgaggacaccgccgtgtactattgtgccaagggacctggctggggcagcttcgatctgtggggcagaggaacccttgtgaccgtgtccagcacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3718 - DNA, 1350 bp, Artificial Sequence
  Synthetic Polynucleotide encoding a Bispecific antibody
atggactggatttggcgcatccttttccttgtcggcgctgctaccggcgcccattccgaggttcagttggtcgaatcaggcgggggcctcgtccaacccggcggaagcctgcggctgtcttgcgcagcaagtggtagtgtgttcaagatcaacgttatggcctggtatcgccaggctccgggaaaagggagagagctggttgcggggatcattagcggtggctccaccagctacgctgacagtgtgaagggaaggttcactatatcacgcgacaacgcaaagaatacattgtacctccagatgaatagcttgcggcccgaagacacggcagtctactattgtgcctttatcacaacagagagcgactatgacctgggccgccggtattgggggcagggaacccttgtgaccgtttcatccacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3719 - DNA, 1713 bp, Artificial Sequence
  Synthetic Polynucleotide encoding a Bispecific antibody
atggccttaccagtgaccgccttgctcctgccgctggccttgctgctccacgccgccaggccggacatccagatgacccagagccccagcagcctgtctgccagcgtgggcgacagagtgaccatcacctgtaccgccagcctgagcgtgtccagcacctacctgcactggtatcagcagaagcccggcagcagccccaagctgtggatctacagcaccagcaacctggcctccggcgtgcccagcagattttctggcagcggctctggcaccagctacaccctgaccatcagctccctccagcccgaggacttcgccacctactactgccaccagtaccacagaagccccctgacctttggcggaggcaccaaggtggaaatcaagagaggcggaggcggaagtggaggcggaggatctggcggcggaggctctgaagtgcaactggtggaatctggcggcggactggtgcagcctggcggatctctgagactgagctgtgccgccagcggcttcagcctgaccaaatacggcgtgcactgggtgcgccaggcccctggaaaaggactggaatgggtgggagtgaagtgggctggcggctccaccgactacaacagcgccctgatgagccggttcaccatcagcaaggacaacgccaagaacagcctgtacctccagatgaactccctgcgggccgaggacaccgccgtgtactactgtgccagagatcaccgggacgctatggactactggggccagggaacactcgtgaccgtgtcctctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3720 - DNA, 1725 bp, Artificial Sequence
  Synthetic Polynucleotide encoding a Bispecific antibody
atggccttaccagtgaccgccttgctcctgccgctggccttgctgctccacgccgccaggccggacatccagatgacccagagccccagcagcctgtctgccagcgtgggcgacagagtgaccatcacatgcaaggccagccaggacgtgggaacagccgtggcctggtatcagcagaagcctggcaaggcccccaagctgctgatctacagcgccagctacagatccaccggcgtgcccagcagattttccggctctggcagcggcaccgacttcaccctgaccatctctagcctccagcccgaggacttcgccacctactactgccagcaccactactccgccccctggacatttggcggaggcaccaaggtggaaatcaagggcggaggcggaagtggaggcggaggatctggcggcggaggctctgaagtgcaactggtggaatcaggcggcggactggtgcagcctggcggatctctgagactgagctgtgccgccagcggcttcaccttcagcagaaacggcatgagctgggtgcgccaggcccctggaaaaggactggaatgggtggcaaccgtgtccagcggcggcagctacatctactacgccgacagcgtgaagggccggttcaccatctccagagacaacgccaagaacagcctgtacctccagatgaactccctgcgggccgaggacaccgccgtgtactattgtgccagacagggcaccaccgccctggctaccagattcttcgatgtgtggggccagggcaccctcgtgaccgtgtcatctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3721 - DNA, 1743 bp, Artificial Sequence
  Synthetic Polynucleotide encoding a Bispecific antibody
atggccttaccagtgaccgccttgctcctgccgctggccttgctgctccacgccgccaggccggacatcgtgatgacccagagccccagcagcctgaccatgagcgtgggccagaaagtgaccatgtcctgcaagagcagccacagcctgctgaacagccggaaccagaagaactacctggcctggttccagcagaagcccggccagtcccccaagctgctggtgtacttcgcaagcacccgcgagagcggcgtgcccgacagattcatcggcagcggctccggcaccgacttcaccctgaccatcagcaacgtgcaggccgaggacctggccgactacttctgccagcagcactacaccaccctgcccaccttcggcggaggcaccaagctggaaatcaagggcggaggcggaagtggaggcggaggatctggcggcggaggctctcagatccagctggtgcagagcggccctgacctgaagaaacccggcgagacagtgaagatcagttgcaaggcctccggctacaccttcaccaacacaggcatgaactgggtcaagcaggcccctggcaagggcctgaagtggatgggctggatcaacacctacaccggcgagcccacctacgccgacgacttcaagggccggttcaccttcagcctggaaaccagcgccagcaccgcctacctgcagatcaacaacctgaagaacgaggacaccgccacctatttctgcaccagatggggctacggcagcagcctgtactacgccatggactactggggccagggcaccagcgtgaccgtgtcctctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3722 - DNA, 1713 bp, Artificial Sequence
  Synthetic Polynucleotide encoding a Bispecific antibody
atggccttaccagtgaccgccttgctcctgccgctggccttgctgctccacgccgccaggccggacatccagatgacccagagcccccctagcctgtctgcctctgtgggcggcaaagtgaccatcacatgcaaggccagccaggacatcgaccgctacatggcctggtatcaggacaagcccggcaagggacccaagctgctgatccacgataccagcaccctccagcccggcatccccagcagattttctggcagcggctccggcagagactacagcttcagcatcagcaacctggaacccgaggacattgccacctactactgcctccagtacgacaacctgtggaccttcggcggaggcaccaagctggaaatcaagagaggcggaggcggaagtggaggcggaggatctggcggcggaggctctcaggtgcaactggtgcagagcggagccgagcttgtgaagcctggcgcttccgtgaagatgagctgcaaagccagcggctacatcttcaccaactacaacatccactgggtcaagaagtccccaggccagggcctggaatggatcggagccatctaccccggaaacggcgacgccccttacagccagaagttccaggacagagccaccctgaccgccgacaccagcagcagcaccacctacatggaactgagcagcctgaccagcgaggacagcgccgtgtactattgcgtgcgggccaactgggatgtggccttcgcctattggggccagggcacactggtgtccgtgtcctctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3723 - DNA, 1716 bp, Artificial Sequence
  Synthetic Polynucleotide encoding a Bispecific antibody
atggccttaccagtgaccgccttgctcctgccgctggccttgctgctccacgccgccaggccggacatccagatgacccagagccctgccagcctgtctgcctctgtgggcgagacagtgaccatcacctgtcgggtgtccggcaacatccacaactacctggcctggtatcagcagaagcagggcaagagcccccaactgctggtgtacaacgccaagaccctggccgatggcgtgcccagcagattttctggctctggcagcggcacccagtacagcctgaagatcaacagcctccagcccgaggacttcggcagctactactgccagcacttctggtccaacccctacaccttcggcggaggcaccaagctggaaatcaagggcggaggcggaagtggaggcggaggatctggcggcggaggctctcaggtgcaactccagcagtctggcgcttccgtgaaggtgtcctgcaaggccagcgaactcgtgcggcctggcacaggctacgccttcaccaattacctgatcgagtgggtcaagcagaggcccggacagggcctggaatggatcggagtgattaacccaggcagcggcggcaccaactacaacgagaagttcaagggcaaggccaccctgaccgccgacaagagcagcagcacagcctacatgcaactgagcagcctgaccagcgacgacagcgccgtgtacttctgcgcccggtacagaagctacgactggtacttcgacgtgtggggagccggcaccaccgtgacagtgtcatctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3724 - DNA, 1731 bp, Artificial Sequence
  Synthetic Polynucleotide encoding a Bispecific antibody
atggccttaccagtgaccgccttgctcctgccgctggccttgctgctccacgccgccaggccggacgacatccagatgacccagagccccagcagcctgtctgccagcgtgggcgacagagtgaccatcacctgtcggagcagccagcggatcgtgcacagcaacggcaacacctacctggaatggtatcagcagacccccggcaaggcccccaagctgctgatctacaaggtgtccaacagattcagcggcgtgcccagcaggtttagcggctctggcagcggcaccgactacacccctaccatctctagcctccagcccgaggacattgccacctactactgttttcaaggcagccacgtgccccccaccttcggccagggaacaaagctccagatcaccggcggaggcggaagtggaggcggaggatctggcggcggaggctctgaggtgcaactggtggaatctggcggcggagtggtgcagcctggcagaagcctgagactgagctgtagcagcagcggccctaccttcagcgactactacatgtactgggtgcgccaggcccctggcaagggactggaatgggtggcctacatgagcaacgtgggagccatcaccgattaccccgacaccgtgaagggcagacccaccatcagccgggacaacagcaagaataccctgttcctgatggacagcctgcggcccgaggataccggcgtgtacttttgcgccagaggcaccagggacggcagttggttcgcctattggggccagggcacacccgtgaccgtgtctagtacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3725 - DNA, 1713 bp, Artificial Sequence
  Synthetic Polynucleotide encoding a Bispecific antibody
atggccttaccagtgaccgccttgctcctgccgctggccttgctgctccacgccgccaggccggacatccagatgacccagagcttcagcagcctgagcgccagcgtgggcgacagagtgaccatcacctgtagagccagccaggacatcagcaactacctgaactggtatcagcagaagcccggcaaggcccccaagctgctgatctactacaccagcagactgcacagcggcgtgcccagcagattttctggcagcggctccggcaccgactacaccctgacaatcagctccctgcagcccgaggacttcgctacctacttctgtcagcaaggcaacaccctgccctggacctttggcggaggcaccaagctggaaatcaagagaggcggaggcggaagtggaggcggaggatctggcggcggaggctctgaagtgcaactggtgcagtccggcggagggctggtgcagagcggaggatctctgagactgagctgcagagccagcggctacaccttcacccggtactggatgctgtgggtgcgccagaggccaggcaagggactggaatgggtggccgagatcaacccccggaacgaccggaccaactacaacgagaagttcaagacccggttcaccatcagcgtggacagaagcaagaacaccctgtacctgcagatggacagcctgcgggccgaggataccgccgtgtacttttgtgctctgggaggcggctacgctatggactactggggccagggaacccttgtgaccgtgtcctctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3726 - DNA, 1674 bp, Artificial Sequence
  Synthetic Polynucleotide encoding a Bispecific antibody
atggaaatgctccagggcctgctgctgctcctgctgctttctatgggcggagcttgggccagcagagagcctcttagaccttggtgtcaccccatcaacgccatcctggccgtggaaaaagagggctgccctgtctgcatcaccgtgaacaccacaatctgcgccggctactgccccaccatgatgagagtgctgcaagccgttctgcctcctctgcctcaggtcgtgtgcacctatcgggacgtccgcttcgagagcatcagactgcctggatgtcctagaggcgtggaccccgtggtgtcttttcctgtggctctgtcctgtagatgcggcccctgtagaagaagcaccagcgattgcggcggacccaaggatcaccctctgacatgcgatcacccacagctgagcggcctgttgtttcttggcggaggcggaagtggaggcggaggatctggcggcggaggctctgctcctgatgtgcaggattgccctgagtgcaccctgcaagagaaccccttcttctcccaacctggcgctcctatcctccagtgcatgggctgctgcttcagccgggcttatcccacacctctgcggagcaagaaaaccatgctggtccagaaaaacgtgaccagcgagagcacctgttgtgtggctaagagctacaacagagtgaccgtgatgggcggcttcaaggtggaaaatcacaccgcctgccactgctccacctgttactaccacaagagcacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3727 - DNA, 1716 bp, Artificial Sequence
  Synthetic Polynucleotide encoding a Bispecific antibody
atggccttaccagtgaccgccttgctcctgccgctggccttgctgctccacgccgccaggccggacatccagatgacacagtctccggcgtcactgtccgcctccgtgggggagactgtgactattatttgtagggcatcagttaacatctactcttatttggcctggtaccagcagaagcaaggcaagagtcctcagctgctggtgtataatgcgaagatcctggcagagggcgtgccgagccggttctccggcagcggctcaggtacccaattttccctcaagatcaattcactgcagccagaggactttggcagttactattgtcaacaccactacggcacattcactttcgggtccggtacaaaattggagattaagcgaggcggaggcggaagtggaggcggaggatctggcggcggaggctctcaggtacagttgaaagaaagcgggcctggactggtagcgccttcccaatctctctccatcacgtgcaccatctctggcttctccctgacttcctatggagttcactgggtgaggcagccccccggcaagggactggaatggctggtcgtcatctggtccgacgggtccacaacctacaactccgctctgaaaagtcggctctctatttctaaagataatagcaagagccaggtgtttctgaaaatgaactctctgcagaccgatgatacggccatttactactgcgcttcacactatggctcaaccttggcattcgcttcctggggccacggaacactggtgaccgtttccgcagccacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3728 - DNA, 1740 bp, Artificial Sequence
  Synthetic Polynucleotide encoding a Bispecific antibody
atggccttaccagtgaccgccttgctcctgccgctggccttgctgctccacgccgccaggccggacattgtgatgacccagtctcacaaattcatgtccacatcagtaggagacagggtcagcgtcacctgcaaggccagtcagaatgtgggtaataatgtagcctggtatcaacagaaaccagggcaatctcctaaagtactgatttactcggcatcctaccggtacagtggagtccctgatcgcttcacaggcagtggatctgggacagatttcactctcaccatcagtaatgtgcagtctgaagacttggcagagtatttctgtcagcaatataacacctatccattcacgttcggctcggggacaaagttggaaataaaaggcggaggcggaagtggaggcggaggatctggcggcggaggctctgaggtacagctggaggaaagcggtggaggactggtgcaacctggagggtctatgaagctctcttgcgtagcttctgggttcacgttctccaattactggatgaactgggtgcggcagtcccccgagaaaggcctggaatgggtagcagaaattcggttcaagtcccataactatgctacacactttgccgagtctgtcaaaggccggttcactattagtcgagacgacagcaagtcttcagtctacctgcagatgaataacttgcgggcagaggacacaggtatctactactgcaccaggagaatcggcaactccgactatgactggtggtactttgacgtctggggagcaggcaccagcgtgacggtgagttcagcctcaacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3729 - DNA, 1728 bp, Artificial Sequence; identical to SEQ ID NO: 3614
  Synthetic Polynucleotide encoding a Bispecific antibody

SEQ ID NO: 3730 - DNA, 1746 bp, Artificial Sequence
  Synthetic Polynucleotide encoding a Bispecific antibody
atggccttaccagtgaccgccttgctcctgccgctggccttgctgctccacgccgccaggccggaccagagcgtgctgacacagcctccatccgtgtctggcgctccaggccagagagtgaccatctcctgtaccggcagcagcagcaacatcggagccggctatgacgtgcactggtatcagcaactgcccggcaccgcccccaagctgctgatctacggcaacagcaacagacccagcggcgtgcccgatagattcagcggcagcaagagcggcacaagcgccagcctggctatcactggactccaggccgaggacgaggccgactactactgccagagctacgacaacagcctgtcctcctgggtgttcggcggaggcaccaagctgacagtgctgggccagcctaagggcggaggcggaagtggaggcggaggatctggcggcggaggctctgaagtgcaactccagcagagcggagccgaagtgaagaaacccggcagctccgtgaaggtgtcctgcaaggcttccggcggcaccttcagcagctacgccatttcttgggtgcgccaggcccctggacagggcctggaatggatgggcagaatcatccccatcctgggaatcgccaactacgcccagaaattccagggccgcgtgaccatcaccgccgacaagagcacaagcaccgcctacatggaactgagcagcctgcggagcgaggacaccgccgtgtactactgcgccagagatgtgggcagcggctcctacagcctggactattggggccagggcaccctcgtgaccgtgtctagtacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3731 - DNA, 1737 bp, Artificial Sequence
  Synthetic Polynucleotide encoding a Bispecific antibody
atggccttaccagtgaccgccttgctcctgccgctggccttgctgctccacgccgccaggccggaccagagcgtcgtgacacagcctccatctgtgtctgccgcccctggccggaaagtgaccatctcttgtagcggcagcagcagcaacatcggcagcaactacgtgtcctggtatcagcaggtgcccggcaccgcccctaagctgctgatctacgaggacgacaagcggcccagcggcatccccgatagattcagcggctctaagagcggcaccagcgccacactgggcatcaccggactccagacaggcgacgaggccgactacttctgcgccacctgggacagaaccgtgaacgtggtgcgctttggcggcggaaccagactgacagtgcacagccagcctaagggcggaggcggaagtggaggcggaggatctggcggcggaggctctcaactccaactccaggaaagcggccctggcctcgtgaagcctagcgagacactgagcctgacctgcaccgtgtctggcggcagcatctccagcagctcctactactggggctggatcagacagccccctggcaagggcctggaatggatcggctccatctactacagcggaagcacctactacaaccccagcctgaagtcccgcgtgaccatcagcgtggacaccagcaagaaccagttctccctgaagctgagcagcgtgacagccgccgataccgccgtgtactactgtgccagacatgtgggccacgagctggattactggggccagggcacactcgtgaccgtgtctagtacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3732 - DNA, 1719 bp, Artificial Sequence
  Synthetic Polynucleotide encoding a Bispecific antibody
atggccttaccagtgaccgccttgctcctgccgctggccttgctgctccacgccgccaggccggacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacgccgccagctctctgcagtctggcgtgccatctggctttagcggcagcggctctggcaccgacttcaccctgaccatcagctccctgcagcccgaggacttcgccacctactactgccagcagagctacagcacccccctgacctttggcggaggcaccaaggtggaaatcaagagaggcggcggaggctcaggcggaggcggatctggcgggggaggatctcaggtgcaactgcaggaatctggccctggcctcgtgaagcccagcgagacactgagcctgacctgtaccgtgtctggcggctctgtgtccagcggcagctactactggtcctggatcagacagccccctggcaagggcctggaatggatcggctacatctactacagcggctccaccaactacaaccccagcctgaagtcccgcgtgaccatctccgtggacaccagcaagaaccagttctccctgaagctgagcagcgtgacagccgccgataccgccgtgtactactgtgccagagagggcaagaacggggccttcgacatctggggccagggcacaatggtcaccgtgtcctctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3733 - DNA, 1377 bp, Artificial Sequence
  Synthetic Polynucleotide encoding a Bispecific antibody
atggccctgcccgtgacagccctgctgctgcctctggctctgctgctgcacgccgccagacccgatgaattcgatgttcagttggtggagtctggtggcggtttggtgcagccaggtggctccctgcgactcagttgtgcagcctccgggttcattctggattactacgctattggttggtttcgacaggcccccggaaaggagagagagggcgtgctctgcattgatgccagcgacgacattacctactacgccgattctgtgaagggccgcttcaccatcagtagagacaatagcaagaatacagtctacctgcagatgaactccctgcgcccagaagacactgccgtctactactgtgctacccctatcgggctttcttcctcttgccttctcgaatatgactacgattactgggggcaggggacgctggtcaccgtgtctagcacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3734 - DNA, 1866 bp, Artificial Sequence
  Synthetic Polynucleotide encoding a Bispecific antibody
atggccctgcccgtgacagccctgctgctgcctctggctctgctgctgcacgccgccagacccgatgaattcgatgttcagttggtggagtctggtggcggtttggtgcagccaggtggctccctgcgactcagttgtgcagcctccgggttcattctggattactacgctattggttggtttcgacaggcccccggaaaggagagagagggcgtgctctgcattgatgccagcgacgacattacctactacgccgattctgtgaagggccgcttcaccatcagtagagacaatagcaagaatacagtctacctgcagatgaactccctgcgcccagaagacactgccgtctactactgtgctacccctatcgggctttcttcctcttgccttctcgaatatgactacgattactgggggcaggggacgctggtcaccgtgtctagcctcgagggaggtagcggctccgggggaggcggaagtggaggcggaggatctgggtctggaggaagcggatctggaggctcagggtcagggggctcaggcagtggaggctctttcgaagtgcaactggtggagtccggcggtggactggtacagcctgggggttcactgcgcctgtcctgcgccgccagcggaagaacctattacctcaatgctatgggttggttccgccaggccccaggaaaggagcgcgagttcgtggcggctattgactggtccgaggggaacaaggactatgctgattccgtgaagggcaggtttaccatcagccgggataattcaaaaaatactgtttatttgcagatgaactctcttagaccagaagacactgctgtctattactgcgccgctgacacccctccttggggaccactgatttatatcgaaagctatgattcctgggggcagggcacactcgtcaccgtgagtagcacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3735 - DNA, 1719 bp, Artificial Sequence
  Synthetic Polynucleotide encoding a Bispecific antibody
atggccttaccagtgaccgccttgctcctgccgctggccttgctgctccacgccgccaggccggaccagatcgtgctgacccagtcccccgctattatgtccgcatcaccgggcgaaaaagtgacgatctcctgtagcgcttcatctagcgtctcctacatgtattggtatcaacagaaacctgggtctagcccaaagccgtggatctacagaaccagtaaccttgccagtggggtgccagcccgcttcagcggtagtggcagtggaacttcctatagcctcacaataagcaacatggaggctgaagatgccgctgcctattactgccagcagtaccacagttacccaaccacgttcggcgggggaactaagctcgaagtaaaaggcggaggcggaagtggaggcggaggatctggcggcggaggctctgaggtgcagctggtggaatctgggggcggcctggtccaacctaagggatcactcaagctctcttgtgcggccagcggattctctttcaatacctatgctatgaattgggtgagacaggcgcccggaaagggcctcgaatggatagcccatatccggtcaaaatcaaacaatttcgcaacctactatgcggactccgtgaaggaccgattttccatctcccgagatgcctccgagaatattctgttcctgcagatgaataacctcaagacagaggacaccgccatgtactactgtgtgcgccagggcggtgactttcccatggattactgggggcaggggaccagcgtgaccgtgagctctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3736 - DNA, 1716 bp, Artificial Sequence
  Synthetic Polynucleotide encoding a Bispecific antibody
atggccttaccagtgaccgccttgctcctgccgctggccttgctgctccacgccgccaggccggacgacatccagatgacccagagcagcagcagcttcagcgtgagcctgggcgacagagtgaccatcacctgcatggccagcgaggacatctacatcagactggcctggtaccagcagaagcccggcaacgcccccagactgctgatcagcgccgccaccagcctggagaccggcgtgcccagcagattcagcggcagcggcagcggcaaggactacaccctgagcatcaccagcctgcagaccgaggacgtgggcacctactactgccagcagtactggagcagcccctggaccttcggcggcggcaccaagctggagatcaacggcggaggcggaagtggaggcggaggatctggcggcggaggctctgacgtgcagctgcaggagagcggccccggcctggtgaagcccagccagagcctgagcctgacctgcaccgtgaccggctacagcatcaccagcgactacacctggaactggatcagacagttccccggcaacaagctggagtggatgggctacatcacctacagcggcagcaccagctacaaccccagcctgaagagcagaaacagcatcaccagagacaccagcaagaaccagttcttcctgcagctgaacagcgtgaccaccgaggacaccgccacctactactgcgccagactgggcagaagatacacaatggactactggggccagggcaccagcgtgaccgtgagcagcacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3737 - DNA, 1713 bp, Artificial Sequence
  Synthetic Polynucleotide encoding a Bispecific antibody
atggccctgcctgtgacagctctgctgctgcctctggcactgctgctgcacgccgccagacctgatgtgcagctccaggaaagcggccctggcctcgtgaagcctagccagagcctgagcctgacatgcaccgtgaccggctacagcatcaccagcgactacacctggaactggatcagacagttccccggcaacaagctggaatggatgggctacatcacctacagcggcagcaccagctacaaccccagcctgaagtcccggaactccatcaccagagacaccagcaagaaccagttcttcttgcagctgaacagcgtgaccaccgaggacaccgccacctactactgcgccagactgggcagacggtacaccatggactattggggccagggcacctccgtgaccgtgtctagcggaggcggaggaagtggcggcggaggatctgggggaggcggaagcgatatccagatgacccagtccagcagcagcttcagcgtgtccctgggcgacagagtgaccatcacctgtatggcctccgaggacatctacatccggctggcctggtatcagcagaagcccggcaacgcccccagactgctgattagcgccgccacctctctggaaaccggcgtgccaagcagattcagcggctctggcagcggcaaggactacaccctgagcatcacctccttgcagaccgaggacgtgggcacctactattgccagcagtattggagcagcccctggacctttggcggaggcacaaagctggaaatcaacacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3738 - DNA, 1716 bp, Artificial Sequence
  Synthetic Polynucleotide encoding a Bispecific antibody
atggccctgcctgtgacagctctgctgctgcctctggcactgctgctgcacgccgccagacctgacatccagatgacccagagcagcagcagcttcagcgtgtccctgggcgacagagtgaccatcacatgcaaggccagcgaggacatctacatccggctggcctggtatcagcagaagcccggcaacgcccccagactgctgattagcgccgccacctctctggaaaccggcatccccagcagattctccggctctggcagcggcgaggactacaccctgacaatcaccagcctccagaccgaggacgtggcaacctactactgccagcagtattggaccaccccctggacctttggcggaggcaccaagctggaaatcaagagaggcggaggcggaagtggaggcggaggatctggcggcggaggctctgatgtgcagctccaggaatctggccccggactcgtgaagcctagccagagcctgagcctgacatgcaccgtgaccggctacagcatcaccatcgactacacctggaactggatcagacagttccccggcaacaaactggaatggatgggctacatcacctacagcggcagcaccgactacaaccccagcctgaagtccagaagctccatcaccagagacacctctatgaaccagttcttcttgcagctgaacagcgtgaccaccgaggacaccgccacctactattgcgccagactgggcagaagatacgccctggactattggggccagggcaccagcgtgacagtgtcctctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3739 - DNA, 1719 bp, Artificial Sequence
  Synthetic Polynucleotide encoding a Bispecific antibody
atggccttaccagtgaccgccttgctcctgccgctggccttgctgctccacgccgccaggccggacatcgtaatgacccaggctgccccatccataccagtcactcccggtgaatccgtgtctatatcttgtaggtccgataagagtctgcttcacagcaacggcaatacttatcttttctggtttttgcagcgaccgggacaaagcccacaactgctgatctatagaatgtcaaatcttgcatcaggggtcccagatcgctttagtggatctgggtcaggcacagctttcaccctgagaatctccggagtggaagcagaagacgtaggcgtgtattactgtatgcagcaccttgagtatccttatacctttggaggcggaactaagctcgaaattaaaggcggaggcggaagtggaggcggaggatctggcggcggaggctctcaggttcaactgcagcagtctggacctgaactggtgaagcctggggcctcagtgaagatgtcctgcaaggcttctggctacgcattcagtagttcctggttgaactgggtgaggcagaggcctggaaagggtcttgagtggattggacggatttatcctggagatggagaaaatcactataatgggaaattcaagggcaaggccacactgactgcagacaaatcctccagcacaggctacatgcaactcagcagcctgacgtctgaggactctgcggtctacttctgtgcaagttattatgaagggggttattggggccaagggactctaatcactgtctctgcaacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3740 - DNA, 1716 bp, Artificial Sequence
  Synthetic Polynucleotide encoding a Bispecific antibody
atggccttaccagtgaccgccttgctcctgccgctggccttgctgctccacgccgccaggccggacatcgtactgacacagagccccgcttctctggcagtgtcactgggccagtccgttacaatatcctgtcgggcgagtgaatccgtggaatactatggaacaagtctcatgcagtggtatcagcagaaacctggacagccccccaagctgctcatctacggtgcgtcaaatgtcgagagtggggttccggcccgattcagtggttccgggagtggcacagactttagcctcaacatccatcctgttgaggaagacgatattgccatgtatttttgccaacagtcccgcaaagtcccctggacctttggtggaggaactaagctggagatcaagggcggaggcggaagtggaggcggaggatctggcggcggaggctctgaggtcaagctggtagagagtggaggtgggctggttaaaccaggggggagcagaaaactgagttgtgccgcaagtggcttcaccttttctagctataccatgagctgggtaagacaaactccagcaaagcgccttgagtgggtcgcaacaattagcagcggatcttctactatttattacgctgacactgttaagggccggtttaccatatcaagagacaacgccaagaatacccttttccttcaaatgacttcactgcggtccgaggatacggcaatgtactattgtgcacgacggtggtttctcgactgctggggccaggggactacccttaccgtgtctagtacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3741 - DNA, 1725 bp, Artificial Sequence
  Synthetic Polynucleotide encoding a Bispecific antibody
atggccttaccagtgaccgccttgctcctgccgctggccttgctgctccacgccgccaggccggaccaggtgcagctgcagcagtcgggcccaggactggtgaagccttcggagaccctgtccctcacctgcactgtctctggtgactccatcagtagttactactggagctggatcaggcagcccccagggaagggactggagtggattgggtatatctattacagtgggagcaccaactacaacccctccctcaagagtcgagtcaccatatcagtagacacgtccaagagccagttctccctgaagctgagctctgtgaccgccgcagacacggccgtgtattactgtgcgcgcggcaggtacttcgatgtctggggacgaggcactatggtgactagcagcggcggaggcggaagtggaggcggaggatctggcggcggaggctcttcctcctacgtgctgactcagcctccctccgtgtctgggtctcctggacagtcgatcaccatctcctgcactggaaccagcagtgacgttggtggttataactatgtctcctggtaccaacaacacccaggcaaagcccccaaactcatgatttatgagggcagtaagcggccctcaggggtttctaatcgcttctctggctccaagtctggcaacacggcctccctgacaatctctgggctccaggctgaggacgaggctgattattactgcagctcatatacaaccaggagcacccgagttttcggcggagggaccaagctgaccgtcctaggtgccgccgcaacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3742 - DNA, 1728 bp, Artificial Sequence
  Synthetic Polynucleotide encoding a Bispecific antibody
atggccttaccagtgaccgccttgctcctgccgctggccttgctgctccacgccgccaggccggacatcgtaatgacacagtctcccctgtccctccctgtcacaccaggtgaacctgccagtatttcttgtagatccagtaagtcacttctgcactccaatgggaacacctacctgtattggttccagcaaaagcctggtcaggcacctcgcttgcttatttataggatgtccaatcttgcatccggcgtgccagaccgattctcaggctccggctctggtactgcatttaccctgaaaatctcccgcgtggaagcagaagatgtgggcgtgtactactgtatgcagcacatcgagtaccccttcacgtttggtcaaggcacaaagctggaaatcaaaggcggaggcggaagtggaggcggaggatctggcggcggaggctctcaggtccagctcgtccagtctggacccgaagtcaagaagccaggcgcctctgtgaaggtttcttgtaaggccagcggatatacattcactaattcatggatgaactgggtgaggcagcgccctggcaaggggcttgagtggatcgggcggatttacccaggggatggcgagacaatttacaacgggaaatttcgggtgagagtgacgatcaccgcagacgaatctacaagcacggcctacatggagttgtcctctctcaggagtgaggacaccgccgtctactattgtgctagaggttatgacgactattcattcgcatactggggccagggcaccaccgtcacagtatcatctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3743 - DNA, 1728 bp, Artificial Sequence
  Synthetic Polynucleotide encoding a Bispecific antibody
atggccttaccagtgaccgccttgctcctgccgctggccttgctgctccacgccgccaggccggacgagatcgtgatgacccagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccaccagtacggcagcagcccccagacctttggacagggcaccaaggtggaaatcaagcggggcggaggcggaagtggaggcggaggatctggcggcggaggctctgaagtgcagctggtgcagtctggggccgaagtgaagaaacccggcagctccgtgaaggtgtcctgcaaggcttccggcggcaccttcagcagctacgccatttcttgggtgcgccaggcccctggacagggactggaatggatgggcggcatcatccccatcttcggcaccgccaactacgcccagaaattccagggcagagtgaccatcaccgccgacgagagcaccagcaccgcctacatggaactgagcagcctgcggagcgaggacacagccgtgtattattgcgccgtgcactacggcgactacgtgttcagcagcatggacgtgtggggccagggcacaaccgtgaccgtgtcatctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3744 - DNA, 1737 bp, Artificial Sequence
  Synthetic Polynucleotide encoding a Bispecific antibody
atggccttaccagtgaccgccttgctcctgccgctggccttgctgctccacgccgccaggccggacgagacaaccctgacacagagccctggcaccctgagcctgtctccaggcgaaagagccacactgagctgtcgggccagccagagcgtgtccagctcttacctggcctggtatcagcagaagcccggccaggctccccggctgctgatctatggcgcttctagcagagccaccggcatccccgatagattcagcggctctggcagcggcaccgacttcaccctgaccatcagcagactggaacccgaggacttcgccgtgtactactgccagcagtacggcagcagccccagaacattcggccagggcaccaaggtggaaatcaagagaggcggaggcggaagtggaggcggaggatctggcggcggaggctctgaagtgcaactggtgcagagcggagccgaagtgaagaaacccggcagctccgtgaaggtgtcctgcaaggcttccggcggcaccttcagcagctacgccatttcttgggtgcgccaggcccctggacagggcctggaatggatgggcggcatcatccccatcttcggcaccgccaactacgcccagaaattccagggcagagtgaccatcaccgccgacgagagcaccagcaccgcctacatggaactgagcagcctgcggagcgaggacacagccgtgtattattgcgccagaggccccgagtattgcatcaacggcgtgtgcagcctggacgtgtggggccagggaacaaccgtgaccgtgtctagcacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3745 - DNA, 1743 bp, Artificial Sequence
  Synthetic Polynucleotide encoding a Bispecific antibody
atggccttaccagtgaccgccttgctcctgccgctggccttgctgctccacgccgccaggccggacatcgagctgacccagagccctagcagcctggctgtgtctgccggcgagaaagtgaccatgagctgcaagagcagccagagcctgctgaacagccggacccggaagaatcaactggcctggtatcagcagaagcccggccagtctcccgagctgctgatctactgggccagcaccagacagagcggcgtgcccgatagattcacaggcagcggctccggcaccgacttcaccctgacaatcagcagcgtgcaggccgaggacctggccgtgtactactgccagcagagctacaacctgctgaccttcggccctggcaccaagctggaagtgaagagaggcggaggcggaagtggaggcggaggatctggcggcggaggctctgtgaagctgcaggaatctggcggcggattcgtgaagcctggcggctctctgaaggtgtcctgtgccgccagcggcttcaccttcagcagctacgccatgtcctgggtgcgcctgagccccgagatgagactggaatgggtggcaaccatcagctccgcaggcggctacatcttctacagcgactccgtgcagggccggttcaccatctccagagacaacgccaagaacaccctgcatctgcagatgggcagcctgagaagcggcgacaccgccatgtactattgcgccagacagggcttcggcaactacggcgactactacgctatggactactggggccagggaaccaccgtgaccgtgtctagtacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3746 - DNA, 1740 bp, Artificial Sequence
  Synthetic Polynucleotide encoding a Bispecific antibody
atggccttaccagtgaccgccttgctcctgccgctggccttgctgctccacgccgccaggccggacatccagatgacccagagccccagcagcctgtctgccagcgtgggcgacagagtgaccatcacctgtcggagcagccagaacatcgtgcacagcaacggcaacacctacctggactggtatcagcagacccccggcaaggcccccaagctgctgatctacaaggtgtccaacagattcagcggcgtgcccagcaggtttagcggctctggcagcggcaccgacttcaccttcaccatcagctccctccagcccgaggacattgccacctactactgcttccagtacagccacgtgccctggaccttcggccagggcacaaagctccagatcggcggaggcggaagtggaggcggaggatctggcggcggaggctctcaggtgcagctccagcagtctggggccgaagtgaagaaacccggcagcagcgtgaaggtgtcctgcaaggccagcggctacacctttaccaactactacatctactgggtgcgccaggccccaggccagggactggaatggatcggcggcatcaatcctaccagcggcggcagcaacttcaacgagaagttcaagacccgcgtgacaatcaccgccgacgagagcagcaccaccgcctacatggaactgagcagcctgcggagcgaggataccgccttctacttctgcacccggcagggcctgtggttcgactctgatggcagaggcttcgacttctggggccagggaaccaccgtgaccgtgtctagtacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3747 - DNA, 1428 bp, Artificial Sequence
  Synthetic Polynucleotide encoding a Bispecific antibody
atggccttaccagtgaccgccttgctcctgccgctggccttgctgctccacgccgccaggccgctgttcaaccaggaagtgcagatccccctgaccgagagctactgcggcccctgccccaagaactggatctgctacaagaacaactgctaccagttcttcgacgagagcaagaattggtacgagagccaggcttcctgcatgagccagaacgccagcctgctgaaggtgtacagcaaagaggaccaggatctgctgaagctggtcaagagctaccactggatgggcctggtgcacatccccaccaacggctcttggcagtgggaggacggcagcatcctgagccccaacctgctgaccatcatcgagatgcagaagggcgactgcgccctgtacgccagcagcttcaagggctacatcgagaactgctccacccccaacacctacatctgtatgcagcggaccgtgggcggaggcggaagtggaggcggaggagacacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3748 - DNA, 1710 bp, Artificial Sequence
  Synthetic Polynucleotide encoding a Bispecific antibody
atggccttaccagtgaccgccttgctcctgccgctggccttgctgctccacgccgccaggccggagatcgtgctgacacagagccctggcaccctgagcctgtctccaggcgaaagagccacactgagctgtcgggccagccagagcgtgtccagctcttacctggcctggtatcagcagaagcccggccaggctccccggctgctgatctatggcgcttctagcagagccaccggcatccccgatagattcagcggctctggcagcggcaccgacttcaccctgaccatcagcagactggaacccgaggacttcgccgtgtactactgccagcagtacggcagcagcccctggacctttggacagggcaccaaggtggaaatcaagagaggcggaggcggaagtggaggcggaggatctggcggcggaggctctcaagtgcatctccaggaaagcggacccggcctcgtgaagcctagcgagacactgagcctgacctgcaccgtgtccgacgacagcatcagcagctactactggtcctggatcagacagccccctggcaagggcctggaatggatcggccacatcagctacagcggcagcgccaactacaaccccagcctgaagtccagagtgaccatctccgtggacaccagcaagaaccagttctccctgaagctgagcagcgtgacagccgccgacaccgccgtgtattattgcgccaactgggacgacgccttcaacatctggggccagggcacaatggtcaccgtgtctagcacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3749 - DNA, 1716 bp, Artificial Sequence
  Synthetic Polynucleotide encoding a Bispecific antibody
atggccttaccagtgaccgccttgctcctgccgctggccttgctgctccacgccgccaggccggacgtcgtgatgacccagacccctctgaccctgagcgtgaccattggacagcccgccagcatctcctgcaagagcagccagagcctgctggacagcgacggcaagacctatctccactggctgttgcaacggccaggtcagagccccaagagactgatcttcctggtgtccaagctggactccggcgtgcccgatagattcacaggcagcggctccggcaccgacttcaccctgaagatcagccgggtggaagccgaggacctgggcgtgtactactgttggcagggcacccacttcccccagacctttggcggcggaacaaagctggaaatcaagggcggaggcggaagtggaggcggaggatctggcggcggaggctctgtgcaactccaagagtccggccctgacctcgtgaagcctagccagtctctgagcctgacctgcaccgtgaccggctacagcatcaccagcggctactcttggcactggatcagacagttccccggcaacaagctggaatggatgggctacatccactacagcggcgacaccgactacaaccccagcctgaagtcccggttctccatcaccagagacaccagcaagaaccagttcttcttgcaactgaactccgtgaccaccgaggacaccgccacctactactgtgccacccctggcggctttgtgtactggggccagggaacactcgtgaccgtgtcctctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3750 - DNA, 1728 bp, Artificial Sequence
  Synthetic Polynucleotide encoding a Bispecific antibody
atggccttaccagtgaccgccttgctcctgccgctggccttgctgctccacgccgccaggccggaccagagcgagctgacccagcctagaagcgtgtccggcagccctggacagagcgtgaccatcagctgtaccggcaccgagagagatgtgggcggctacaactacgtgtcctggtatcagcagcaccccggcaaggcccccaagctgatcatccacgacgtgatcgagcggagcagcggcgtgcccgatagattcagcggcagcaagagcggcaacaccgccagcctgacaatcagcggactgcaggccgaggacgaggccgactactactgctggtctttcgctggcggctactacgtgttcggcaccggcacagatgtgaccgtgctgggcggaggcggaagtggaggcggaggatctggcggcggaggctctttcgaagtgcagctgctggaatctggcggcggactggtgcagcctggcggatctctgagactgagctgtgccgcctccggcttcaccttcagcacctaccagatgagctgggtgcgccaggcccctggcaaaggactggaatgggtgtccgggatcgtgtccagcggcggctctacagcctacgccgatagcgtgaagggccggttcaccatcagccgggacaacagcaagaacaccctgtacctgcagatgaacagcctgagagccgaggacaccgccgtgtactattgtgccggcgagctgctgccctactacggcatggatgtgtggggccagggcaccaccgtgaccgtgtcatctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3751 - DNA, 1725 bp, Artificial Sequence
  Synthetic Polynucleotide encoding a Bispecific antibody
atggccttaccagtgaccgccttgctcctgccgctggccttgctgctccacgccgccaggccggaccagagcgagctgacccagcctagaagcgtgtccggcagccctggacagagcgtgaccatcagctgtaccggcaccgagagagatgtgggcggctacaactacgtgtcctggtatcagcagcaccccggcaaggcccccaagctgatcatccacgacgtgatcgagcggagcagcggcgtgcccgatagattcagcggcagcaagagcggcaacaccgccagcctgacaatcagcggactgcaggccgaggacgaggccgactactactgctggtctttcgctggcggctactacgtgttcggcaccggcacagatgtgaccgtgctgggcggaggcggaagtggaggcggaggatctggcggcggaggctctgaagtgcagctgctggaatctggcggcggactggtgcagcctggcggatctctgagactgagctgtgccgccagcggcttcaccttcagcacctacgagatgcactgggtgcgccaggcccctggcaaaggactggaatgggtgtccgtgatcctgagcagcggcggagagacaaactacgccgacagcgtgaagggccggttcaccatcagccgggacaacagcaagaacaccctgtacctccagatgaacagcctgcgggccgaggacaccgccgtgtactattgtgccggaatgctgctgccctactacggcatggatgtgtggggccagggcaccaccgtgaccgtgtcatctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3752 - DNA, 1431 bp, Artificial Sequence
  Synthetic Polynucleotide encoding a Bispecific antibody
atggccttaccagtgaccgccttgctcctgccgctggccttgctgctccacgccgccaggccgggctggtttctggacagccctgacagaccctggaatcctccaacattcagccccgctctgctggtggttaccgagggcgataatgccaccttcacctgtagcttcagcaacaccagcgagagcttcgtgctgaactggtacagaatgagccccagcaaccagaccgacaagctggccgcctttcctgaggatagaagccagcctggacaggactgccggttcagagttacccagctgcctaacggcagagacttccacatgagcgttgtgcgggccagaagaaacgacagcggcacatatctgtgcggagccatctctctggcccctaaggctcagatcaaagagagcctgagagccgagctgagagtgacagaaagacgggccgaagtgcccacagctcacccttcaccttctccaagacctgccggccagttccagacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3753 - DNA, 1716 bp, Artificial Sequence
  Synthetic Polynucleotide encoding a Bispecific antibody
atggccttaccagtgaccgccttgctcctgccgctggccttgctgctccacgccgccaggccggacatccagatgacacagagccctagcagcctgtctgccagcgtgggagacagagtgaccatcacctgtagagccagccaggatgtgtctacagccgtggcctggtatcagcagaagcctggaaaggcccctaagctgctgatctacagcgccagctttctgtacagcggcgtgcccagcagattttctggcagcggctctggcaccgacttcaccctgacaatatccagcctccagcctgaggacttcgccacctactactgccagcagtacctgtatcaccccgccacctttggacagggcaccaaggtggaaatcaagagaggcggaggcggaagtggaggcggaggatctggcggcggaggctctgaagtgcagctggttgaatcaggtggcggcctggttcaacctggcggatctctgagactgagctgtgccgccagcggcttcacctttagcgacagctggattcactgggtccgacaggcccctggcaaaggacttgaatgggtcgcctggatcagcccttatggcggcagcacctattacgccgacagcgtgaagggcagattcaccatcagcgccgacaccagcaagaacaccgcctacctccagatgaactccctgagagccgaagataccgccgtgtactactgcgccagaaggcattggcctggcggctttgattattggggccagggcacactggtcaccgtgtcatctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3754 - DNA, 1719 bp, Artificial Sequence
  Synthetic Polynucleotide encoding a Bispecific antibody
atggccttaccagtgaccgccttgctcctgccgctggccttgctgctccacgccgccaggccggccatcgtgatgacccagacaccttctccagtgtctgccgccgttggcggcacagtgacaatcaactgtcaggccagcgagagcgtgtacagcaacaactacctgagctggttccagcagaagcccggccagcctcctaagctgctgatctacctggcctccacactggcaagcggagtgcccagtagattcaaaggcagcggctctggcacccagttcaccctgacaattagcggcgtgcagtgtgacgatgccgccacctattactgcatcggcggcaagagcagcagcaccgatggcaatgcttttggcggcggaacagaggtggtcgttagaggcggaggcggaagtggaggcggaggatctggcggcggaggctctcaatctctggaagaaagcggaggcagactggtcaagcccgacgagacactgaccatcacctgtaccgtgtccggcatcgacctgagcagcaatggactgacctgggtccgacaagctcctggcgaaggactggaatggatcggcaccatcaacaaggacgccagcgcctactatgcctcctgggccaaaggcaggctgaccatctctaagcccagctccacaaaggtggacctgaagatcacaagccccaccaccgaggacaccgccacatacttttgtggccggatcgccttcaagaccggcacctctatttggggacctggcacactggtcaccgtgtctagtacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3755 - DNA, 1713 bp, Artificial Sequence
  Synthetic Polynucleotide encoding a Bispecific antibody
atggccttaccagtgaccgccttgctcctgccgctggccttgctgctccacgccgccaggccggacatccagatgacacagagccctagcagcctgtctgccagcgtgggagacagagtgaccatcacctgtagagccagccagggcatctcttcttggctggcctggtatcagcagaagcccgagaaggcccctaagagcctgatctatgccgccagctctctccagagcggagtgcctagcagattttctggcagcggctccggcaccgatttcaccctgacaatatccagcctccagcctgaggacttcgccacctactactgccagcagtacaacagctacccctacaccttcggccagggcaccaagctggaaatcaaaggcggaggcggaagtggaggcggaggatctggcggcggaggctctcaagtgcaactggttcagagcggcgctgaagtgaagaaacctggggcctctgtgaaggtgtcctgcaaggcttccggctacacctttaccagctacgacgtgcactgggtccgacaggctccaggacaaagactggaatggatgggatggctgcacgccgataccggcatcaccaagttcagccagaaattccagggccgcgtgacaatcaccagagacacatctgccagcaccgcctacatggaactgagcagcctgagaagcgaggacaccgccgtgtactactgcgccagagagagaatccagctttggttcgactactggggccagggaaccctggtcacagtctcttctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3756 - DNA, 1770 bp, Artificial Sequence
  Synthetic Polynucleotide encoding a Bispecific antibody
atggccttaccagtgaccgccttgctcctgccgctggccttgctgctccacgccgccaggccggacgacatcgtgatgacccagagccccctgagcctgcctgtgacacctggcgagcctgccagcatctcctgtagaagcagccagagcctgctgcacagcaacggctacaactacctcgtgtggtatctccagaagcccggccagagccctcaactgctgatctacctgggcagcatcagagccagcggcgtgcccgatagattttccggcagcggctccggcaccgacttcaccctgaagatcagccgggtggaagccgaggacgtgggcgtgtactactgtatgcagcccctccagacccccatcaccttcggccagggcaccagactggaaatcaagagaggcggaggcggaagtggaggcggaggatctggcggcggaggctctggactccagtgtgtggccgctcctagatgggtgctgagccaggtgcaactccagcagtggggagccggactgctgaagcctagcgagacactgagcctgacatgcgccgtgtacggcggcagcttcagcggcaattactggtcctggatcagacagccccctggcaagggcctggaatggatcggcgagatcaaccacagcggcagcaccaactacaaccccagcctgaagtccagagtgaccatcagcgtggacaccagcaagaaccagttctccctgaagctgagcagcgtgacagccgccgacaccgccgtgtattactgtgccagaggcggctcctacaattacttcgactactggggccagggaaccctcgtgaccgtgtctagtacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3757 - DNA, 1761 bp, Artificial Sequence
  Synthetic Polynucleotide encoding a Bispecific antibody
atggccttaccagtgaccgccttgctcctgccgctggccttgctgctccacgccgccaggccggaccagctgacacagagccctagcagcgtgtcagccagcgtgggcgacagagtgaccatcacctgtagagccagccggggcatcagctcttggctggcctggtatcagcagaagcccggcaaggcccccaagctgctgatctacacagccagcagcctccagagcggcgtgcccagcagattttctggcagcggctccggcaccgacttcaccctgacaatcagcagcctccagcccgaggacttcgccacctactactgccagcaggcttacagcttcccccggacctttggccagggcaccaaggtggaaatcaagcggggcggaggcggaagtggaggcggaggatctggcggcggaggctctgtggctgctcctagatgggtgctgagccaggtgcagctccaggaatctggccccggactcgtgaagcctagccagaccctgagcctgacctgtaccgtgtctggcggcagcatcagcagcggcggctactactggatctggatcagacagcaccctggcaagggcctggaatggatcggctacatctactacaacggcaacacctactataaccccagcctgaagtcccgcgtgaccatgagcgtggacaccagcaagaaccagttctccctgaagctgtccagcgtgacagccgccgataccgccgtgtactactgcgccagagatggcatcaccatgatccggggctactattacggcatggacgtgtggggccagggaaccaccgtgaccgtgtcatctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3758 - DNA, 1683 bp, Artificial Sequence
  Synthetic Polynucleotide encoding a Bispecific antibody
atggccttaccagtgaccgccttgctcctgccgctggccttgctgctccacgccgccaggccggacatcgtcgtgacacagagccctgcttccctggccgtgtccctgggacagagagccaccatcagctaccgggccagcaagagcgtgtccaccagcggctacagctacatgcactggaaccagcagaagcccggccagccccctagactgctgatctacctggtgtccaacctggaaagcggcgtgcccgccagattttctggcagcggctctggcaccgacttcaccctgaacatccaccccgtggaagaagaggacgccgccacctactactgccagcacatcagagagctgaccagaagcgagggcggaccctcttggaagggcggaggcggaagtggaggcggaggatctggcggcggaggctctgaagtgaagctggaagagtctggcggcgaccttgtgaagcctggcggcagcctgaagctgagctgtgccgccagcggctttaccttctccggctacggcatgagctgggtgcgccagacccccgacaagagactggaatgggtggcaaccatcagcagcggcggcagctacacctactatcccgacagcgtgaagggccggttcaccatctccagagacaacgccaagaacaccctgtacctgcagatgtcctccctgaagtccgaggacaccgccatgtactattgcgccaggcacgaaggcggctactacggcagttctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3759 - DNA, 1731 bp, Artificial Sequence
  Synthetic Polynucleotide encoding a Bispecific antibody
atggccttaccagtgaccgccttgctcctgccgctggccttgctgctccacgccgccaggccggacgacatccagatgacccagagccccagcagcctgtctgccagcgtgggcgacagagtgaccatcacctgtagagccagccagggcatcagcaactacctggcctggtatcagcagaaaaccggcaaggtgcccaagttcctgatctacgaggccagcaccctgcagagcggcgtgccaagtagattttccggcggaggcagcggcaccgacttcaccctgacaatcagctccctgcagcccgaggacgtggcaacctactactgccagaactacaacagcgcccccttcaccttcggccctgggaccaaggtggacatcaagggcggaggcggaagtggaggcggaggatctggcggcggaggctctcaggtgcaactggtggaatctggcggaggcgtggtgcagcctggcagaagcctgagactgagctgtgccgccagcggcttcgccttcagcagatacggaatgcactgggtgcgccaggcccctggcaaaggactggaatgggtggccgtgatttggtacgacggcagcaacaagtactacgccgacagcgtgaagggccggttcaccatcagccgggacaacagcaagaacacccagtacctgcagatgaacagcctgcgggccgaggataccgccgtgtactattgtgccagaggcggcgacttcctgtactactactattacggcatggacgtgtggggccagggaaccaccgtgaccgtgtcatctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3760 - DNA, 1704 bp, Artificial Sequence
  Synthetic Polynucleotide encoding a Bispecific antibody
atggccttaccagtgaccgccttgctcctgccgctggccttgctgctccacgccgccaggccggacatccagatgacccagagccccagcagcctgtctaccagcgtgggcgatagagtgaccctgacctgcaaggccagccaggatgtgggaaccgccgtggactggtatcagcagaagcctggccccagccccaagctgctgatctactgggccagcaccagacacaccggcatccccagcagattttccggcagcggctccggcaccgacttcaccctgacaatcagctccctgcagcccgaggacttcgccgactactactgccagcagtacaacagctaccccctgaccttcggccctgggaccaaggtggacatcaagggcggaggcggaagtggaggcggaggatctggcggcggaggctctgaagtgcaactggtgcagagcggccctgaagtgaagaaacccggcgctaccgtgaagattagctgcaagaccagcggctacaccttcaccgagtacaccatccactgggtcaagcaggcccctggcaagggcctggaatggatcggcaacatcaaccccaacaacggcggcaccacctacaaccagaagttcgaggacaaggccaccctgaccgtggacaagagcaccgacaccgcctacatggaactgagcagcctgcggagcgaggataccgccgtgtactattgtgccgccggatggaacttcgactactggggacagggcaccctgctgaccgtgtctagtacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3761 - DNA, 1707 bp, Artificial Sequence
  Synthetic Polynucleotide encoding a Bispecific antibody
atggccttaccagtgaccgccttgctcctgccgctggccttgctgctccacgccgccaggccggacatccagatgacccagagccccagcagcctgtctgccagcgtgggcgacagagtgaccatcacatgcaaggccagccaggacatctacccctacctgaactggttccagcagaagcccggcaaggcccccaagaccctgatctaccggaccaacagactgctggacggcgtgcccagcagattttctggcagcggctccggcaccgacttcaccttcaccatcagctccctccagccctactactgcctccagtacgacgagttccccctgacctttggagccggcaccaagctggaaatcaagagaggcggaggcggaagtggaggcggaggatctggcggcggaggctctcagatcaccctgaaagagtccggccccaccctcgtgaagcctacccagaccctgacactgacctgcaccttcagcggcttcagcctgagcaccagcaacatgggcgtgggctggatcagacagcctcccggaaaagccctggaatggctggcccacatttggtgggacgacgacaagtactacagccccagcctgaagtcccggctgacaatcaccaaggacaccagcaagaaccaggtggtgctgaccatgaccaacatggaccccgtggacaccgccacctactattgcgtgcggagcaactacggctacgcttggtttgcctactggggccagggcaccctcgtgaccgtgtcatctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3762 - DNA, 1707 bp, Artificial Sequence
  Synthetic Polynucleotide encoding a Bispecific antibody
atggccttaccagtgaccgccttgctcctgccgctggccttgctgctccacgccgccaggccggacatcgtgatgacccagagccagaaattcatgagcaccagcgtgggcgacagagtgaacgtgacctgcaaggccagccagaacgtgggcaccaacgtcgtgtggtatcagcagaaaaccggccagagccccaaggccctgatccacagcgccagctacagatacagcggcgtgcccgacagattcaccggcagcggctctggcaccgacttcaccctgaccctgagcaacgtgcagagcgaggacctggccgaatacttctgccagcactacaacagcttcccttacaccttcggcggaggcaccaagctggaaatcaagagaggcggaggcggaagtggaggcggaggatctggcggcggaggctctcaggtgcaactccagcagagcggagccgaactcgtgcggcctggcgtgtccgtgaagattagctgcaagggctccggctacaggttcaccgactaccccatccactgggtcaagcagagccacgccaagagcctggaatggatcggcatcatcagcacctactacggcgacgtgaccaacaaccccaagttccggggcaaggccaccatgacagtggacaagagcagcaccaccgcctacatggaactggcccggctgaccagcgaggactccgccatctactactgcgcccggaacgacctgttcgcctattggggccagggcaccctcgtgacagtgtctgctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3763 - DNA, 1716 bp, Artificial Sequence
  Synthetic Polynucleotide encoding a Bispecific antibody
atggccttaccagtgaccgccttgctcctgccgctggccttgctgctccacgccgccaggccggacatcaagatgacccagagccccagctctatgtacgccagcctgggcgagcgcgtgaccatcacctgtaaagccagccccgacatcaacagctacctgagctggttccagcagaagcccggcaagagccccaagaccctgatctaccgggccaacagactggtggatggcgtgcccagcagattctctggcggcggaagcggccaggactacagcctgaccatcaactccctggaatacgaggacatgggcatctactactgcctccagtacgacgagttcccctacaccttcggcggaggcaccaagctggaaatgaaaggcggaggcggaagtggaggcggaggatctggcggcggaggctctgaagtgaagctggtggaatcaggaggaggcctcgtgaaacctggcggctctctgaagctgagctgtgccgccagcggcttcaccttcagcagctacgccatgagctgggtgcgccagattcccgagaagcggctggaatgggtggcctccattagcagaggcggcaccacctactaccccgacagcgtgaagggccggttcaccatctccagagacaacgtgcggaacatcctgtacctccagatgagcagcctgcggagcgaggacaccgccatgtactactgcggcagatacgactacgacggctactacgctatggactactggggccagggcaccagcgtgaccgtgtcatctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3764 - DNA, 1725 bp, Artificial Sequence
  Synthetic Polynucleotide encoding a Bispecific antibody
atggccttaccagtgaccgccttgctcctgccgctggccttgctgctccacgccgccaggccggacgacgtggtcgtgacccctgtgtcctgcttcctgagctgcatctctggcgccgagggccaccacctgattcagggccagcagaagtgccagtacatctggctgctgtacgccctggaacccaccgagacaagaaccgccacccagacccctcacctgtcctgcatccagcccagaatctggggaccctgccaggtgcagtggcagtgggtgtgggatagactgcacccccagcaccctagttgtggcggcggaggctgttgcaacctgctgctgtctgcccacggcgcctacacatttggcggaggcacccggctggaactgaaaggcggaggcggaagtggaggcggaggatctggcggcggaggctctgaagtgaagctccaggaaagcggccctgagctcgtgaagcctggcgcctctgtgaagatgagctgcaaggccagcggctacaccttcaccagctacgtgatgcactgggtcaagcagaagcccggccagggcctggaatggatcggctacatcaacccctacaacgacggcaccaagtacaacgagaagttcaagggcaaggccaccctgaccagcgacaagagcagcagcaccgcctacatggaactgagcagcctgacctccgaggacagcgccgtgtactactgcgcccggtggaaaatctactacggcaactacgaggactactggggccagggcacacccctgacagtgtctagtacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3765 - DNA, 1815 bp, Artificial Sequence
  Synthetic Polynucleotide encoding a Bispecific antibody
atggccttaccagtgaccgccttgctcctgccgctggccttgctgctccacgccgccaggccggacgaattccaggtgcaactggtgcagtctggcggagggctggtgcagccagggggatctctgagactgagctgtgccgccagcgacttcgacttcgccgcctacgagatgagctgggtgcgccaggctcctggacagggactggaatgggtggccatcatcagccacgacggcatcgacaagtattacaccgacagcgtgaagggccggttcaccatcagccgggacaacagcaagaacaccctgtacctgcagatgaataccctgcgggccgaggacaccgccacctactattgcctgagactgggagccgtgggccagggcacacttgtgacagtgtctagcctcgagggaggaggcggctccgggggaggcggaagtggaggcggaggatctgggtctggaggaagcggatctggaggctcagggtcagggggctcaggcagtggaggcagcttcgaacaggtgcaactggtgcagagcggaggcggactggtgcagcctgggggcagtctgaggctgtcttgtgccgcctccgatttcgccttcgatgattacgagatgtcttgggtgcggcaggccccaggcaaagccctggaatggatcggcgacatcaaccacagcggcaccaccatctacaaccccagcctgaagtccagagtgaccatctccagagacaactccaagaatactctgtacctgcagatgaacacactgagagccgaagatacagccatctactactgcgccagaccccactacggcgactacagcgacgccttcgacatctggggccagggaaccatggtcaccgtgtcctctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3766 - DNA, 1740 bp, Artificial Sequence
  Synthetic Polynucleotide encoding a Bispecific antibody
atggccttaccagtgaccgccttgctcctgccgctggccttgctgctccacgccgccaggccggagatcgtgatgacccagagccctgccaccctgtccgtgtctccaggcgaaagagccaccctgagctgtagagccagccagagcgtgtccagcaacctggcctggtatcagcagaagcccggccaggctccccggctgctgatctatggcgcttctaccagagccaccggcatccccgccagattttctggcagcggctccggcaccgacttcaccctgacaatcagctccctccagtccgtggacagcgccgtgtactactgccagcagtacaacaactggcccccctacaccttcggccagggcaccaagctggaaatcaagggcggaggcggaagtggaggcggaggatctggcggcggaggctctcaggtgcaactgctggaaagcggagggggcgtggtgcagcctggaagaagcctgagactgagctgtgccgccagcggcttcaccttcagcttctacggaatgcactgggtgcgccaggcccctggcaaaggactggaatgggtggccgccatcagctacgacggcagcaacaagtattacgccgacagcgtgaagggccggttcaccatcagccgggacaacagcaagaacaccctgtacctccagatgaacagcctgcgggccgaggacacagccgtgtattattgcgccaagcggcccaaccagttctactgctccgacggcagatgctacagcatcgactactggggccagggaaccctcgtgaccgtgtctagtacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3767 - DNA, 1728 bp, Artificial Sequence
  Synthetic Polynucleotide encoding a Bispecific antibody
atggccttaccagtgaccgccttgctcctgccgctggccttgctgctccacgccgccaggccgcagagcgtgctgacacagcctcctagtgcctctgccggcggaacacctggacagagagtgaccatctcctgctccggcagcagcagcaacatcggcagcaacttcgtgtactggtatcagcaactgcccggcaccgcccccaagctgctgatctacagaaacaaccagcggcccagcggcgtgcccgatagattctctggaagcagaagcggcaccagcgccagcctggctggactgagaagcgaggacgaggccgactactactgtgccgccgatagcctgggcggccactacgtgttcggcaccggaacaaaagtgctgggcggaggcggaagtggaggcggaggatctggcggcggaggctctcaggtgcaactggtggaatctggcggaggctctgtgcagcctggcagaagcctgagactgagctgtgaagcctccggcttcaccttcgaggcttacgccatgcactgggtgcgccagccacctggcaaaggactggaatgggtgtccagcatcaactggaacagcggcagaatcgcctacgccgacagcgtgaagggccggttcaccatcagccgggacaacgccagaaacagcctgtacctccagatgaacagcctgcggctggaagataccgccttctactactgcgccaaggacatccggcggttcagcacaggcggagccgagtttgagtattggggccagggcaccctcgtgaccgtgtctagtacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3768 - DNA, 1713 bp, Artificial Sequence
  Synthetic Polynucleotide encoding a Bispecific antibody
atggccttaccagtgaccgccttgctcctgccgctggccttgctgctccacgccgccaggccggagaacgtgctgacacagagccctgccatcatgagcgcttccccaggcgagaaagtgaccatgacatgtagcgccagcagcagcgtgtcctacatgcactggtatcagcagaagtccagcacaagccccaagctgtggatctacgacaccagcaaactggcctctggcgtgccaggcagattttctggcagcggcagcggaaacagctacagcctgacaatcagcagcatggaagccgaggacgtggcaacctactactgctttcaaggcagcggctaccctctgacctttggagccggaacaaagctggaactgaaaggcggaggcggaagtggaggcggaggatctggcggcggaggctctcaggtgcagctgaaagaatctggccctggactggtggcccctagccagtctctgagcatcacctgtaccgtgtccggcttcagcctgagttctcagggcgtgtactgggtccgacagcctcctggaaaaggactggaatggctgggagccatttgggctggcggcagcaccaattacaacagcgccctgatgagccggctgagcatctccaaggacaacagcaagagccaggtgttcctgaagatgaacagcctccagaccgacgacaccgccatgtactactgcgccagagtggatggctaccggggctacaacatggactattggggccagggcaccagcgtgacagtctcttctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3769 - DNA, 1725 bp, Artificial Sequence
  Synthetic Polynucleotide encoding a Bispecific antibody
atggccttaccagtgaccgccttgctcctgccgctggccttgctgctccacgccgccaggccggacgacatccagatgacccagagccccagcagcctgtctgccagcgtgggcgacagagtgaccatcacctgtagagccagccagagcatcagcagctacctgaactggtatcagcagaagcccggcaaggcccccaaactgctgatctacgacgccagcaacctggaaaccggcgtgcccagcagattttccggcagcggctctggcaccgacttcaccttcaccatcagctccctccagcccgaggacattgccacctactactgccagcagtacgacaacctgcccctgacctttggcggaggcaccaaggtggacatcaagagaggcggaggcggaagtggaggcggaggatctggcggcggaggctctcaggtgcaactggtggaatctggcggcggagtggtgcagcctggcagaagcctgagactgagctgtgccgccagcggcttcacctttagcagctacgccatgcactgggtgcgccaggcccctggaaaaggcctggaatgggtggccgtgatctcctacgacggctccaacaagtattacgccgacagcgtgaagggccggttcaccatctccagagacaacagcaagaacaccctgtacctccagatgaacagcctgcgggccgaggacaccgccgtgtactattgtgccagggctcacaacagcagctcttggagcttcgactactggggccagggcaccctcgtgaccgtgtcatctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3770 - DNA, 1752 bp, Artificial Sequence
  Synthetic Polynucleotide encoding a Bispecific antibody
atggccttaccagtgaccgccttgctcctgccgctggccttgctgctccacgccgccaggccggacgacgtcgtgatgacccagagccctctgagcctgcctgtgtccctgggcgatcaggccagcatctcctgcagatccagccagagactggtgcacagcaacggcaacacctacctgcactggtatctgcagaagcccggccagagccccaagctgctgatctaccgggtgtccaacagattccccggcgtgcccgatagattcagcggctctggcagcggcaccgacttcaccctgaagatcagccgggtggaagccgaggacctgggcatctatttctgcagccagagcacccacgtgccctacacctttggcggaggcaccaagctggaaatcaagcggggcggaggcggaagtggaggcggaggatctggcggcggaggctctgaagtgcggctgcagcagtctggccccgacctgattaagcctggggccagcgtgaagatgagctgcaaggccagcggctacaccttcaccggctacgtgatgcactgggtcaagcagaggccaggccagggcctggaatggatcggcttcatcaacccctacaacgacgacatccagagcaacgagcggttccggggcaaggccaccctgaccagcgataagagcagcaccaccgcctacatggaactgagcagcctgacctccgaggacagcgccgtgtactactgtgctaggggagccggctacaacttcgacggggcctacagattcttcgacttttggggccagggcaccacactgaccgtgtcctctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3771 - DNA, 1725 bp, Artificial Sequence
  Synthetic Polynucleotide encoding a Bispecific antibody
atggccttaccagtgaccgccttgctcctgccgctggccttgctgctccacgccgccaggccggacagctacgagctgacccagcctcctagcgtgtccgtgtctcctggacagaccgccaccatctcttgcagcggcgatcaactgggcgggaagtacggccactggtatcagaagaagcccggccagagccccgtgctggtgctgtaccaggacagaaaacggcctgccggcatccccgagagattcagcggaagcagcagcggcaacaccatcaccctgaccatcagcggcacccaggccgtggatgaggccgactactactgccaggcttgggacaccaatctgggcggcgtgttcggcggaggcaccaaagtgacagtgctgggacagggcggaggcggaagtggaggcggaggatctggcggcggaggctctcaggtgcaactggtggaaagcggagccgaagtgaagaaacctggggccagcgtgaaggtgtcctgcaaggccagcggctacacctttaccggctactacatgcactgggtgcgccaggctccaggccagggactggaatggatgggccggatcaaccccaatagcggcggcaccaactacgcccagaaattccagggcagagtgaccatgaccagagacaccagcatcagcaccgcctacatggaactgagccggctgagaagcgacgacaccgccgtgtactactgcgccagccctagaggcagaggcagcgccttcgatatttggggccagggcacactcgtgaccgtgtcctctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3772 - DNA, 1734 bp, Artificial Sequence
  Synthetic Polynucleotide encoding a Bispecific antibody
atggccttaccagtgaccgccttgctcctgccgctggccttgctgctccacgccgccaggccggacaacttcatgctgacccagccccacagcgtgtccgagagccctggcaagaccgtgaccatctcctgcaccagaagcagcggctctatcgccagcaaatacgtgcagtggtatcagcagaggcccggcagcagccctaccaccgtgatctacgaggacaaccagaggcctagcggcgtgcccgatagattcagcggcagcatcgacaccagcagcaacagcgccagcctgaccatcagcggcctgagaacagaggacgaggccgactactactgccacagctacgacagcaacaaccactccgtgttcggcggaggcaccaaagtgacagtgctgggacagggcggaggcggaagtggaggcggaggatctggcggcggaggctctgaagtgcaactggtggaaagcgggggaggcgtggtgcagccaggcggatctctgagactgagctgtgccgccagcggcttcaccttcagcagctacgccatgagctgggtgcgccaggcccctggaaaaggcctggaatgggtgtccgccatctctggctctggcggcagcacctactacgccgatagcgtgaagggccggttcagcatcagccgggacaacagcaagaacaccctgtacctccagatgaacagcctgcgggccgaggacaccgccgtgtactactgtgccagaaccagaagctccggggccttcgacatctggggccagggaacactcgtgaccgtgtcctctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3773 - DNA, 1719 bp, Artificial Sequence
  Synthetic Polynucleotide encoding a Bispecific antibody
atggccttaccagtgaccgccttgctcctgccgctggccttgctgctccacgccgccaggccggacatccagatgaaccagagccccagcagcctgagcgccagcctgggcgataccatcaccatcacctgtcacgccagccagaacatcaacgtgtggctgagctggtatcagcagaagcccggcaacatccccaagctgctgatctacaaggccagcaacctgcacaccggcgtgcccagcagattttctggcagcggctctggcaccggcttcaccattaccatcagctccctccagcccgaggacattgccacctactactgccagcagggccagagctacccctggacatttggcggaggcaccaagctggaaatcaagagaggcggaggcggaagtggaggcggaggatctggcggcggaggctctgaagtgcaactccagcagagcggcccagagcttgtgaagcctggcgcttccgtgaagattagctgcaaagccagcggctacagcttcaccggctacttcatgaactgggtcaagcagagccacggcaagagcctggagtacatcggcagattcaacccctacaacggcgagacactgtacaaccagaagttcaagggcaaggccaccctgaccgtggacaagagcagcagcaccgtgcacatggaactgctgagcgtgaccagcgaggacagcgccgtgtactactgtggcagaagcggcaacgacgacgctatggactattggggccagggcaccagcgtgaccgtgtctagtgctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3774 - DNA, 1722 bp, Artificial Sequence
  Synthetic Polynucleotide encoding a Bispecific antibody
atggccttaccagtgaccgccttgctcctgccgctggccttgctgctccacgccgccaggccggacgacatccagatgacccagagccccagcatcctgagcgccagcgtgggcgacagagtgaccatcacctgtcgggccagccagagattcggcgactacctggcctggtatcagcagaagcctggacaggcccccaagctgctgatctacggcgcttccacactccagagcggcgtgcccagcagattttctggcagcggctccggcaccgagttcaccctgacaatcagcggcctccagcccgaggacttcgccacctactattgccagcaggccaacagcttccctatcaccttcggcaagggcacccggctggacatcagaagaggcggaggcggaagtggaggcggaggatctggcggcggaggctctcaggtgcagctggtgcagtctggggccgaagtgaagaaacccggcagcagcgtgaaggtgtcctgcaaggcttccggcggcaccttcagcagctacgccatttcttgggtgcgccaggccccaggacagggcctggaatggatgggctggatcaacgtgggcaacggcaacgccatctacagccagaaattccagggccgcgtgacaatcaccagagacaccagcgccaccaccgcctacatggaactgagcagcctgcggagcgaggacaccgccgtgtactactgtgccagggatggcgagagagcctgggacctggattattggggccagggcacactcgtgaccgtgtcctctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3775 - DNA, 1737 bp, Artificial Sequence
  Synthetic Polynucleotide encoding a Bispecific antibody
atggccttaccagtgaccgccttgctcctgccgctggccttgctgctccacgccgccaggccggacgagacaaccctgacacagagccctggcaccctgagcctgtctccaggcgaaagagccacactgagctgtcgggccagccagagcgtgtccagctcttacctggcctggtatcagcagaagcccggccaggctccccggctgctgatctatggcgcttctagcagagccaccggcatccccgatagattcagcggctctggcagcggcaccgacttcaccctgaccatcagcagactggaacccgaggacttcgccgtgtactactgccagcagtacggcagcagcccctacacattcggccagggcaccaagctggaaatcaagagaggcggaggcggaagtggaggcggaggatctggcggcggaggctctcaggtgcaactggtgcagtctggcggcggagtggtgcagcctggaagaagcctgagactgtcctgtgccgccagcggcttcaccttcagcagctacgccatgcactgggtgcgccaggcccctggaaaaggactggaatgggtggccgtgatctcctacgacggcagcaacaagtattacgccgacagcgtgaagggccggttcaccatctccagagacaacagcaagaacaccctgtacctccagatgaacagcctgcgggccgaggacacagccgtgtattattgcgccagagagctgcggttcctggaatggtccagcgacgccttcgacatctggggccagggaacaatggtcaccgtgtcctccacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3776 - DNA, 1722 bp, Artificial Sequence
  Synthetic Polynucleotide encoding a Bispecific antibody
atggccttaccagtgaccgccttgctcctgccgctggccttgctgctccacgccgccaggccggagatcgtgctgacacagagccctgccaccctgtctctgagccctggcgaaagagccaccctgagctgtagagccagccagagcgtgcggagctacctggcctggtatcagcagaagcctggacaggcccccagactgctgatctacgacgccagcaatcgggccacaggcatccccgccagattttctggctctggcagcggcaccgacttcaccctgacaatcagcagcctggaacccgaggacttcgccgtgtactactgccagcagcggagcaactggccccctacctttggacagggcaccaaggtggaaatcaagggcggaggcggaagtggaggcggaggatctggcggcggaggctctcaactccaggtgcaggaatctggccccggactcgtgaagcccagcgagacactgagcctgacctgtaccgtgtccggcggcagcatcagcaacagctacttctcctggggctggatcagacagccccctggcaagggcctggaatggatcggcagcttctactacggcgagaaaacctactacaaccccagcctgaagtccagagccaccatcagcatcgacaccagcaagagccagttctccctgaagctgagcagcgtgacagccgccgacaccgccgtgtattattgccccagaggccccaccatgatccggggcgtgatcgactcttggggccagggaacactcgtgaccgtgtcctctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3777 - DNA, 1713 bp, Artificial Sequence
  Synthetic Polynucleotide encoding a Bispecific antibody
atggccttaccagtgaccgccttgctcctgccgctggccttgctgctccacgccgccaggccggacatccagatgacacagagccctagcagcctgtctgccagcgtgggagacagagtgaccatcacctgtagagccagccagggcatctcttcttggctggcctggtatcagcagaagcccgagaaggcccctaagagcctgatctatgccgccagctctctccagagcggagtgcctagcagattttctggcagcggctccggcaccgatttcaccctgacaatatccagcctccagcctgaggacttcgccacctactactgccagcagtacaacagctacccctacaccttcggccagggcaccaagctggaaatcaaaggcggaggcggaagtggaggcggaggatctggcggcggaggctctcaagtgcaactggttcagagcggtgccgaagtgcggaagcctggcagctctgtgaaggtgtcctgtaaagcctccggcggcagcttcaacaactaccccatcttctgggtccgacaggcccctggacagggctttgaatggatgggcagaatcatccccatcctgggcatcaccgcctacgctcagaaattccagggccgcgtgacaatcaccgccgacaagtctacaagcacagcctacatggaactgaacagcctgcggagcgaggacaccgccgtgtattattgtgccggcggagatgacctggacgcctttgacatttggggccagggaacaatggtgtccgtgtcctctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3778 - DNA, 1749 bp, Artificial Sequence
  Synthetic Polynucleotide encoding a Bispecific antibody
atggccttaccagtgaccgccttgctcctgccgctggccttgctgctccacgccgccaggccggacatcgtgatgacccagacccccctgagcctgcctgtgacacctggcgagcctgccagcatctcctgcagaagcagcagaagcctgctggacagcgacgacggcaacacctacctggactggtatctgcagaaacccggccagagcccccaactgctgatctacaccctgagctacagagccagcggcgtgcccgatagattttccggctctggcagcggcaccgacttcaccctgaagatcagccgggtggaagccgaggacgtgggcgtgtactactgtatgcagcgggtggaatttcccatcaccttcggccagggcaccagactggaaatcaagagaggcggaggcggaagtggaggcggaggatctggcggcggaggctctcaggtgcaactggtggaatctggcgggggagtggtgcagcctggcagatccctgagactgagctgtgccgccagcggcttcatcttcagcagatacggaatgcactgggtgcgccaggcccctggcaagggactgaaatgggtggccgtgatttggtacgacggcagcaacaagctgtacgccgacagcgtgaagggccggttcaccatcagcagagacaacagcaagaacaccctgtacctgcagatgaacagcctgcgggccgaggacaccgccgtgtactattgcgccagagactactacgacaacagccggcaccactggggcttcgactattggggccagggaacccttgtgaccgtgtcctctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3779 - DNA, 1719 bp, Artificial Sequence
  Synthetic Polynucleotide encoding a Bispecific antibody
atggccttaccagtgaccgccttgctcctgccgctggccttgctgctccacgccgccaggccggagatccagatgacccagagccccagcagcatgtctgccagcctgggcgacaccatcaccatcacatgccaggccacccaggacatcttcaagaacctgaactggtatcagcagaagcccggcaagccccccagcctgctgatctactatgccaccgaactggccgagggcgtgcccagcagattttctggcagcggcagcggctccgactacagcctgaccatcagcaacctggaaagcgaggacttcgccgcctactactgcctccagttcttcgagttcccattcaccttcggctccggcaccaagctggaaatgaagggcggaggcggaagtggaggcggaggatctggcggcggaggctctcaggtgcaactccagcagtctggcgctgagcttgtgcggcctggcacctctgtgaaggtgtcctgtaaagccagcggctacgtgttcaccaactactggatcgagtggatcaagcagcggccaggccagggcctggaatggatcggcgtgatgaatccaggcagcggcgagacaacctacaacgagaagttcaagggcaaggccaccctgaccgccgacaagagcagcagcacagcctacatgcaactgtcctccctgaccagcgtggacagcgccgtgtacttctgcgccagggaccacgaccgggactactacgctatggactactggggccagggcaccagcgtgaccgtgtcatctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3780 - DNA, 1710 bp, Artificial Sequence
  Synthetic Polynucleotide encoding a Bispecific antibody
atggccttaccagtgaccgccttgctcctgccgctggccttgctgctccacgccgccaggccggacatcctgctgacacagagccccgccatcctgtccgtgtctccaggcgagagagtgtcctttagctgccgggccagccagaacatcggcaccagcatccactggtatcagcagcggaccaacggcagccccagactgctgattaagtacgccagcgagtccgtgtccggcatccccagcagattttctggcagcggctccggcaccgacttcaccctgagcatcaacagcgtggaaagcgaggacattgccgactactactgccagcacaccaatagctggcccaccacctttggcggaggcaccaagctggaaatcaagagaggcggaggcggaagtggaggcggaggatctggcggcggaggctctcaggtgcaactccagcagtccgacgccgagcttgtgaagcctggcgcttccgtgaagattagctgcaaggccagcggctacaccttcaccgaccacgccattcactgggtcaagcagaagcccgagcagggcctggaatggatcggctacttcagccccggcaacggcgacatcaagtacaacgagaagttcaagggcaaggccaccctgaccgccgacaagagcagcagcacagcctacatgcaactgaacagcctgaccagcgaggactccgccgtgtacttctgcaagcggagctacggcaactacgactactggggccagggcaccacactgaccgtgtctagtacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3781 - DNA, 1725 bp, Artificial Sequence
  Synthetic Polynucleotide encoding a Bispecific antibody
atggccttaccagtgaccgccttgctcctgccgctggccttgctgctccacgccgccaggccggacatcgtgatgacccagagccccgatagcctggccgtgtctctgggagagagagccaccatcaactgcaagagcagccagagcctgctgaacagcggcgaccagaagaactacctgacctggtatcagcagaagcccggccagccccccaagctgctgatctactgggccagcaccagagaaagcggcgtgcccgatagattcagcggcagcggaagtggcaccgacttcaccctgaccatcagttctcttcaggccgaggacgtggccgtgtactactgccagaacgactacagctaccccctgaccttcggccagggcaccaaggtggaaatcaagggcggaggcggaagtggaggcggaggatctggcggcggaggctctcaggtgcagctggtgcagtctggggccgaagtgaagaaaaccggcagcagcgtgaaggtgtcctgcaaggccagcggctacacctttaccgaccacgccattcacgtgtggcggcaggctccaggacaggccctggaatggatgggccacttcagccccggcaacaccgacatcaagtacaacgacaagttcaagggcagagtgaccctgaccgtggaccgcagcatgagcaccgcctacatggaactgagcagcctgcggagcgaggacaccgccatgtactattgcaagaccagcaccttctttttcgactactggggccagggaacaatggtcaccgtgtccagcacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3782 - DNA, 1491 bp, Artificial Sequence
  Synthetic Polynucleotide encoding a Bispecific antibody
atggagctgactgaattgctcctcgtggtcatgcttctcctaactgcaaggctaacgctgtccagcccggctcctcctgcttgtgacctccgagtcctcagtaaactgcttcgtgactcccatgtccttcacagcagactgagccagtgcccagaggttcaccctttgcctacacctgtcctgctgcctgctgtggactttagcttgggagaatggaaaacccagatggaggagaccaaggcacaggacattctgggagcagtgacccttctgctggagggagtgatggcagcacggggacaactgggacccacttgcctctcatccctcctggggcagctttctggacaggtccgtctcctccttggggccctgcagagcctccttggaacccagcttcctccacagggcaggaccacagctcacaaggaccctaatgccatcttcctgagcttccaacacctgctccgaggaaaggtgcgtttcctgatgcttgtaggagggtccaccctctgcgtcaggcgggccccacccaccacagctgtccccagcagaacctctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3783 - DNA, 1722 bp, Artificial Sequence
  Synthetic Polynucleotide encoding a Bispecific antibody
atggccttaccagtgaccgccttgctcctgccgctggccttgctgctccacgccgccaggccggacatccagatgacccagagccccagcagcctgtctgccagcgtgggcgacagagtgaccatcacatgcaaggccagccaggacgtgtccattgccgtggcctggtatcagcagaagcccggcaaggcccccaaggtgctgatctacagcgccagctacagatacaccggcgtgcccgacagattcagcggctctggcagcggcaccgacttcaccttcaccatcagctccctccagcccgaggatattgccgtgtactactgccagcagcactacatcacccccctgacctttggcggaggcaccaaggtggaaatcaagggcggaggcggaagtggaggcggaggatctggcggcggaggctctcagatccaactggtgcagagcggccacgaagtgaagaaacctggggccagcgtgaaggtgtcctgcaaagccagcggctacacctttaccaactacggcatgaactgggtgcgccaggcccctggacagggcctggaatggatgggctggatcaacaccaagaccggcgagcccacctacgccgaagagttcaagggcagattcgtgttcagcctggaaaccagcgcctccaccgcctacctccagatcagctctctgaaggccgaggacaccgccatgtacttttgcggcagaggcggctacggcagcagctactggtacttcgatgtgtggggccagggcaccaccgtgaccgtgtcatctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3784 - DNA, 1728 bp, Artificial Sequence
  Synthetic Polynucleotide encoding a Bispecific antibody
atggccttaccagtgaccgccttgctcctgccgctggccttgctgctccacgccgccaggccggacatcgtgatgacccagagccccgatagcctggccgtgtctctgggagagagagccaccatcaactgccgggccagcaagagcgtgtccaccagcggctacagctacatgcactggtatcagcagaagcccggccagccccccaagctgctgatctacctggcctccaacctggaaagcggcgtgcccgatagattcagcggcagcggctctggcaccgacttcaccctgaccatcagttctcttcaggccgaggacgtggccgtgtactactgccagcacagcagagagctgccctacaccttcggccagggcaccaagctggaaatcaagggcggaggcggaagtggaggcggaggatctggcggcggaggctctcaggtgcaactccaggaatctggccctggccttgtgaagcccagcgagacactgagcctgacctgtaccgtgtccggcggcagcatcagctcttacggcgtgcactggattcggcagcctccaggcaagggcctggaatggatcggcgtgatctggacctccggcgtgaccgactacaacagcgccctgatgggcagagtgaccatctccgtggacaccagcaagaaccagttcagcctgaagctgagcagcgtgacagccgccgataccgccgtgtattattgcgccagagatggcgactacgaccgctacacaatggactactggggccagggaacccttgtgaccgtgtcctctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3785 - DNA, 1665 bp, Artificial Sequence
  Synthetic Polynucleotide encoding a Bispecific antibody
atgacagccctgttcctgatgtccatgctgttcggcctggcctgcggacaggccatgtctttctgtatccccaccgagtacaccatgcacatcgagagaagagagtgcgcctactgcctgaccatcaacaccacaatctgcgccggctactgcatgacacgggatattaacggcaagctgttcctgcctaagtacgccctgagccaggacgtgtgcacctaccgggacttcatctaccggaccgtggaaatccctggctgccctctgcatgtggccccttactttagctaccccgtggctctgagctgcaagtgcggcaagtgcaacaccgactacagcgactgtatccacgaggccatcaagaccaactactgcaccaagcctcagaaaagctacctcgtgggcttctctgttggcggaggcggaagtggaggcggaggatctggcggcggaggctctgctcctgatgtgcaggattgccctgagtgcaccctgcaagagaaccccttcttctcccaacctggcgctcctatcctccagtgcatgggctgctgcttcagccgggcttatcccacacctctgcggagcaagaaaaccatgctggtccagaaaaacgtgaccagcgagagcacctgttgtgtggctaagagctacaacagagtgaccgtgatgggcggcttcaaggtggaaaatcacaccgcctgccactgctccacctgttactaccacaagagcacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3786 - DNA, 1716 bp, Artificial Sequence
  Synthetic Polynucleotide encoding a Bispecific antibody
atggccttaccagtgaccgccttgctcctgccgctggccttgctgctccacgccgccaggccgcagagcgtgctgacacagcctcctagcgtgtccgtgtctcctggccagaccgccagcatcacctgtagcggcgataagctgggcgataagtacgcctgctggtatcagcagaagcccggccagtctcccgtgctcgtgatctaccaggacagcaagaggcccagcggcatccccgagagattcagcggcagcaacagcggcaataccgccaccctgaccatcagcggcacccaggctatggacgaggccgactactactgccaggcttgggatagcagcaccgccgtggtgtttggcggaggcaccaagctgacagtgctgggcggaggcggaagtggaggcggaggatctggcggcggaggctctcaggtgcagctggtgcagtctggggccgaagtgaagaagcctggacagagcctgaagatcagctgcaaggccagcggctacagcctgaccgacaactggattggctgggtgcgccagaagccaggcaagggcctggaatggatgggcatcatctaccccggcgacagcgacaccagatacagccctagcttccagggccaagtgaccatctccgccgacaagagcatcaacaccgcctacctccagtggtccagcctgaaagcctccgacaccgccatctactactgtgtgggactggactggaactacaaccccctgcggtactggggacctggcacactcgtgaccgtgtcctctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3787 - DNA, 1710 bp, Artificial Sequence
  Synthetic Polynucleotide encoding a Bispecific antibody
atggccttaccagtgaccgccttgctcctgccgctggccttgctgctccacgccgccaggccggacatcgtgatgacccagagccagaaattcatgagcaccagcgtgggcgaccgggtgtccatcatctgcaaggccagccagaacgtgggcaccttcgtggcctggtatcagcagaagcctggccagagccccaagctgctggtgtacagcgccagcaacagatacaccggcgtgcccgatagattcaccggcagcggctctggcaccgacttcaccctgaccatcaacaacatgcagagcgaggacctggccgactacttctgtcggcagtacagcagctacccctacaccttcggcggaggcaccaagctggaaatcaagggcggaggcggaagtggaggcggaggatctggcggcggaggctctgaagtgcaactccagcagagcggccctgagcttgtgaagccaggggccagcatgaagattagctgcaaagccagcggctacagcttcagcgcctacaccatgaactgggtcaagcagagccacggcaagaacctggaatggatcggcctgattaacccctacaacggcggcaccaactacaaccaggaatttgagggcaaggccaccctgacagtgaacaagagcagcaacaccgccttcatggaactgctgagcctgaccagcgacgacagcgccgtgtactactgcgccagacgggactgggactacttcgactattggggccagggcaccacactgaccgtgtcctctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3788 - DNA, 1743 bp, Artificial Sequence
  Synthetic Polynucleotide encoding a Bispecific antibody
atggccttaccagtgaccgccttgctcctgccgctggccttgctgctccacgccgccaggccggccatccagatgacccagagccctagcagcctgagcgccagcgtgggcgacagagtgaccatcacctgtagagccagccagagcatcagcaactacctgaactggtatcagcagaagcccggcaaggcccccaagctgctgatctatgccgccagctctctccagagcggcgtgcccagcagattttctggcagcggctccggcaccgacttcaccctgacaatcagcagcctccagcccgaggacttcgccacctactactgccagcagagctacagcagcccctccaccacctttggacagggcaccaagctggaaatcaagagaggcggaggcggaagtggaggcggaggatctggcggcggaggctctgaagtgcagctggtggaatctggcggcggactgattcagcctggcggctctctgagactgagctgtgccgcctctggcttcaccgtgtcctccaactacatgagctgggtgcgccaggcccctggcaagggactggaatgggtgtccgtgacatacagcggcggcagcaccagctacgccgatagcgtgaagggccggttcaccatcagccgggacaacagcaagaacaccctgtacctccagatgaacagcctgcgggccgaggacaccgccgtgtactattgtgccaggggaggccggtactgctccagcatcagctgctatgccagaagcggctgcgactactggggccagggaacactcgtgaccgtgtccagtacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3789 - DNA, 1728 bp, Artificial Sequence
  Synthetic Polynucleotide encoding a Bispecific antibody
atggccttaccagtgaccgccttgctcctgccgctggccttgctgctccacgccgccaggccggacatccagatgacccagagccccagcagcctgtctgccagcgtgggcgacagagtgaccatcacctgtagagccagccagagcatcggcaccagcctgcactggtatcagcagaagcctggcaaggcccccaagctgctgattaagttcgccagcagactgcagagcggcgtgcccagcagattttctggcagcggctccggcaccgacttcaccctgacaatcagctccctgcagcccgaggacttcgccacctactactgccagcagagccccggcttccctccaacctttggacagggcaccaagctggaaatcaagcggggcggaggcggaagtggaggcggaggatctggcggcggaggctctcaggtgcaactggtggaatctggcggcggacttgtgaagccaggcggcagcctgagactgagctgtgccgccagcggcttcagcatcaccaccagcggctactactggacctggatcagacagttccccggcaagggcctggaatggatgggctacatcggctacaacagcaagacctactacaaccccgccctgaagtcccggatcaccatcagcagagacaacgccaagaacagcctgtacctgcagatgaactccctgagagccgaggataccgccgtgtactactgcgccagatccctgtacggcggctacaaggacgccttcgatagctggggccagggaacccttgtgaccgtgtctagcacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3790 - DNA, 1743 bp, Artificial Sequence
  Synthetic Polynucleotide encoding a Bispecific antibody
atggccttaccagtgaccgccttgctcctgccgctggccttgctgctccacgccgccaggccggacgagatcgtgctgacccagagccctctgagcctgcctgtgacacctggcgagcctgccagcatctcctgtagaagcagccagagcctgctgcacagcatcggctacaactacctggactggtatctccagaagcccggccagagcccccaactgctgatctacctgggcagcaacagagccagcggcgtgcccgatagattttccggcagcggctccggcaccgacttcaccctgaagatcagccgggtggaagccgaggacgtgggcgtgtactactgtatgcaggccctccagacccccctgacctttggcggaggcaccaaggtggaaatcaagcggggcggaggcggaagtggaggcggaggatctggcggcggaggctctgaagtgcaactggtggaaagcggaggcggcgtggtgcagcctggaagaagcctgagactgagctgtgccgccagcggcttcaccttccggtcctacggaatgcactgggtgcgccaggcccctggcaaaggactggaatgggtggccgtgatctcctacgacggctccaacaagtactacaccgacagcgtgaacggcagattcaccatcagcagagacaacagcaagaacaccctgtacctccagatgaacagcctgcgggccgaggacaccgccgtgtactattgtgctagaggcggaggctactacgagacaagcggccctgattactggggccagggcacactcgtgaccgtgtctagtacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3791 - DNA, 1737 bp, Artificial Sequence
  Synthetic Polynucleotide encoding a Bispecific antibody
atggccttaccagtgaccgccttgctcctgccgctggccttgctgctccacgccgccaggccggacgacgtcgtgatgacccagagccctctgagcctgcctgtgacacctggcgagcctgccagcatctcctgtagaagcagccagagcctgctgcacagcatcggctacaactacctgcactggtttctccagaagcccggccagagcccccaactgctgatctacctgggcagcaacagagccagcggcgtgcccgatagattttccggcagcggctccggcaccgacttcaccctgaagatcagccgggtggaagccgaggacgtgggcgtgtactactgtatgcaggccctccagacccctcccacctttggacagggcaccagactggaaatcaagcggggcggaggcggaagtggaggcggaggatctggcggcggaggctctcaactccaactccaggaaagcggccctggcctcgtgaagcctagcggcacactgagcctgacatgtgccgtgtctggcggcagcatcagcagcagcaactggtggtcttgggtgcgccagcctcctggcaagggcctggaatggatcggcgaaatctaccacagcggcagcaccaactacaaccccagcctgaagtccagagtgaccatcagcgtggacaagagcaagaaccagttctccctgaagctgagcagcgtgacagccgccgataccgccgtgtactattgcgtgggcagcccctacggcgactacgtgctggattattggggccagggcaccctcgtgaccgtgtctagtacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3792 - DNA, 1746 bp, Artificial Sequence
  Synthetic Polynucleotide encoding a Bispecific antibody
atggccttaccagtgaccgccttgctcctgccgctggccttgctgctccacgccgccaggccggacgtcgtgatgacccagagccctctgagcctgcctgtgacacctggcgagcctgccagcatcagctgtagaagcagccagagcctgctgcacagcaacggccacaactacctggactggtatctccagaagcccggccagagcccccagctgctgatctacctgggcagcaatagagccagcggcgtgcccgatagattcagcggctctggaagcggcaccgacttcaccctgaagatcagccgggtggaagccgaggacgtgggcgtgtactactgtatgcagaccctccagacccccctgacctttggccctggcaccaaggtggacatcaagagaggcggaggcggaagtggaggcggaggatctggcggcggaggctctgaagtgcagctggtggaaacaggcggaggcgtggtgcagcctggcagaagcctgagactgagctgtgccgccagcggcttcaccttcagcagctacggaatgcactgggtgcgccaggcccctggcaaaggactggaatgggtggccgtgatctcctacgacggcagcaacaagtattacgccgacagcgtgaagggccggttcaccatctccagagacaacagcaagaacaccctgtacctccagatgaacagcctgcgggccgaggacaccgccgtgtactattgcgccaaggacagatacggctggggcagcagcttcggccacttcgattattggggccagggcaccctcgtgaccgtgtctagtacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3793 - DNA, 1731 bp, Artificial Sequence
  Synthetic Polynucleotide encoding a Bispecific antibody
atggccttaccagtgaccgccttgctcctgccgctggccttgctgctccacgccgccaggccggacgagatcgtgctgacacagagccctggcaccctgagcctgtctctgggagagagagccacactgagctgtcgggccagccagtctatcagcagcagcttcctggcctggtatcagcagaagcccggccaggcccctaagctgctgatctacgccgccagcacaagagccaccggcatccccgatagattcagcggctctggcagcggcaccgacttcaccctgaccatcagcagactggaacccgaggacttcgccgtgtactactgccagcagtacggcagaagcctgagcttcggcggaggcaccaaggtggaagtgaagggcggaggcggaagtggaggcggaggatctggcggcggaggctctcaggtgcaactccagcagtctggccccggactcgtgaagcctagccagacactgagcctgacctgcgccatcagcggcgatagcgtgtccggcaatagcgccacctggaactggatcagacagagcccatctcggggcctggaatggctgggccggacctactaccgcagcaagtggaaccacgactacgccgagagcgtgaagtcccggatcaccatcaaccccgacaccagcaagaaccagttctccttgcaactgaacagcgtgacccccgaggacacagccgtgtattattgcgccagaggcgacagcagctcttggtacgccttcgactattggggccagggcaccctcgtgaccgtgtctagtacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3794 - DNA, 1731 bp, Artificial Sequence
  Synthetic Polynucleotide encoding a Bispecific antibody
atggccttaccagtgaccgccttgctcctgccgctggccttgctgctccacgccgccaggccggaccagaccgtcgtgacacagcctcctagcgcctctggcacaccaggccagagagtgaccatctcctgtagcggcagcagcagcaacatcggcagcaactacgtgtactggtatcagcaactgcccggcaccgcccccaagctgctgatctacagaagcaaccagcggcccagcggcgtgcccgatagattttctggcagcaagagcggcaccagcgccagcctggctatctctggacctagaagcgtggacgaggccgactactactgcgccgcctgggacgatagcctgaacggcgtggtgtttggcggaggcaccaagctgacagtgctgggtggcggaggcggaagtggaggcggaggatctggcggcggaggctctcaggtgcaactggtgcagtctggggccgaagtgaagaaacccggcagctccgtgaaggtgtcctgcaaggcttccggcggcaccttcagcagctacgccatttcttgggtgcgccaggcccctggacagggcctggaatggatgggcggcatcatccccatctttggcaccgccaactacgcccagaaattccagggccgcgtgaccatcaccgccgacgagtctacaagcaccgcctacatggaactgagcagcctgcggagcgaggataccgccgtgtactactgtgccagaagaatccccccctactacggcatggacgtgtggggccagggaaccaccgtgaccgtgtcatctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3795 - DNA, 1731 bp, Artificial Sequence
  Synthetic Polynucleotide encoding a Bispecific antibody
atggccttaccagtgaccgccttgctcctgccgctggccttgctgctccacgccgccaggccggaccagagcgtcgtgacacagcctcctagcgtgtcagtggcccctggcaagaccgccagaatcacctgtggccggaacaacatcggcagcaagagcgtgcactggtatcagcagaagcccggccaggctcctgtgctggtggtgtacgacgacagcgacagacccagcggcatccccgagagattcagcggcagcaactccggcaataccgccaccctgaccatcagcagagtggaagccggcgacgaggccgactactactgccaagtgtgggacagcagcagcgatcacgtggtgtttggcggaggcaccaagctgacagtgctgggtggcggaggcggaagtggaggcggaggatctggcggcggaggctctgaagtgcaactggtgcagtctggcggaggggtcgtgcggcctggcggatctctgagactgtcttgtgccgccagcggcttcaccttcgacgactacggcatgagctgggtgcgccaggcccctggaaaaggcctggaatgggtgtccggcatcaactggaatggcggcagcaccggctacgccgattctgtgcggggcagattcaccatcagccgggacaacgccaagaacagcctgtacctgcagatgaactccctgcgggccgaggacaccgccctgtactattgcgccagagagcggggctacggctaccacgaccctcacgattattggggccagggcacccttgtcaccgtgtcctctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3796 - DNA, 1767 bp, Artificial Sequence
  Synthetic Polynucleotide encoding a Bispecific antibody
atggccttaccagtgaccgccttgctcctgccgctggccttgctgctccacgccgccaggccggaacagaaactcatcagtgaagaagacctggaattccaggctgtcgtgacacagcctcctagcgcctctggcacaccaggccagagagtgaccatctcctgtagcggcagcagcagcaacatcggcagcaacaccgtgaactggtatcagcaggtgcccggcaccgctcccaagctgctgatctacagcaacaaccagcggcccagcggcgtgcccgatagattttctggcagcaagagcggcaccagcgccagcctggctatctctggactccagtccgaggacgaggccgactactattgcgccgcctgggacgatagcctgaacggctgggtgttcggcggaggcaccaagctgacagtgctgggcggaggcggaagtggaggcggaggatctggcggcggaggctctcagatgcaactggtgcagagcggagccgaagtgaaagagcctggcgagagcctgcggatctcctgcaagggcagcggctacagcttcaccaatttctggatctcttgggtgcgccagatgcccggcaagggcctggaatggatgggcagagtggaccccggctactcctacagcacctacagccctagcttccagggccacgtgaccatcagcgccgacaagagcaccagcaccgcctacctccagtggaacagcctgaaggccagcgacaccgccatgtactactgcgccagagtgcagtacagcggctattacgattggttcgacccctggggccagggcacactcgtgacagtgtcaagcacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3797 - DNA, 1749 bp, Artificial Sequence
  Synthetic Polynucleotide encoding a Bispecific antibody
atggccttaccagtgaccgccttgctcctgccgctggccttgctgctccacgccgccaggccggaacagaaactcatcagtgaagaagacctggaattcgacatccagatgacccagagccccagcacactgagcgccagcgtgggcgacagagtgaccatcacctgtcgggccagccagaacatcaacaagtggctggcctggtatcagcagaggcccggaaaagccccccagctgctgatctacaaggccagcagcctggaaagcggcgtgcccagcagattttctggcagcggctctggcaccgagtacaccctgaccatcagctccctccagcccgacgacttcgccacctactactgccagcagtacaacagctacgccaccttcggccagggcaccaaggtggaaatcaagagaggcggaggcggaagtggaggcggaggatctggcggcggaggctctcaggtgcagctggtgcagtctggggccgaagtgaagaagcctggcgagagcctgaagatcagctgcaagggctccggctacaacttctctaacaagtggatcggctgggtgcgccagctgcctggcagaggactggaatggatcgccatcatctaccccggctacagcgacatcacctacagccccagcttccagggccgcgtgacaatcagcgccgacaccagcatcaacaccgcctacctgcactggcacagcctgaaggccagcgacaccgccatgtactactgcgtgcggcatacagccctggctggcttcgattattggggcctgggcaccctcgtgaccgtgtctagtacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3798 - DNA, 1719 bp, Artificial Sequence
  Synthetic Polynucleotide encoding a Bispecific antibody
atggccttaccagtgaccgccttgctcctgccgctggccttgctgctccacgccgccaggccggagatcgtgctgacacagagccctggcaccctgagcctgtctccaggcgaaagagccacactgagctgtcgggccagccagagcgtgtccaatacctacctggcctggtatcaccagaggcccggacaggctccccggctgctgatctatggcgcttctagcagagccaccggcatccccgatagattcagcggctctggcagcggcaccgacttcgccctgacaatcagctccctggaacccgaggacttcgccgtgtactactgccagcagtacagcaactcctggaccttcggccagggcaccaaggtggaaatcaagagaggcggaggcggaagtggaggcggaggatctggcggcggaggctctcaggtgcaactggtggaatctggcgggggagtggtgcagcctggcagaagcctgagactgtcttgtgccgccagcggcttcaccttcagcagctacgacatgcactgggtgcgccaggcccctggcaaaggactggaatgggtggccgtgatctcctacgacggcaccaacgagtattacgccgacagcgtgaagggccggttcaccatctccagagacaccagcaagaacaccctgtacctccagatgaacagcctgcgggccgaggacacagccgtgtattattgcgccagagagcggtacttcgactggtccttcgactactggggccagggaaccctggtgtccgtgtctagtacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3799 - DNA, 1716 bp, Artificial Sequence
  Synthetic Polynucleotide encoding a Bispecific antibody
atggccttaccagtgaccgccttgctcctgccgctggccttgctgctccacgccgccaggccggagctgacacaggaccctgctgtgtctgttgccctgggccagacagtgcggattacctgtcaaggcgacagcctgagaagcaactacgccaactggtatcagcagaagcccggacaggctcccgtgctggttatctacggccagaacaacagacccagcggcatccccgatagattcagcggctctagctctggcaataccgccagcctgacaatcactggcgctcaggctgccgatgaggccgactactactgcgatagcagagtgtccaccggcaatcacgtggtgtttggcggcggaacaaagctgacagtgctcggacaaggcggaggcggaagtggaggcggaggatctggcggcggaggctctgaagttcagctggtgcagagcggagccgaagtgaagaaacctggggcctctgtgaaggtgtcctgcaaggcttccggctacacctttaccagctacgccatgcactgggtccgacaggcacctggacaacggcttgaatggatgggctggatcaacgccggcaacggcaacaccaagtacagccagaaattccagggccgcgtgaccatcaccagagatacaagcgccagcaccgcctacatggaactgtctagcctgagatccgaggacaccgccgtgtactactgtgccagagacatcagctacggcagcttcgactattggggccagggcacactggtcaccgttagctctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3800 - DNA, 1722 bp, Artificial Sequence
  Synthetic Polynucleotide encoding a Bispecific antibody
atggccttaccagtgaccgccttgctcctgccgctggccttgctgctccacgccgccaggccggacatcgtgctgacacagacaccagccacactgagcgtgacacctggcgattctgtgtccctgagctgtagagccagccagagcatcagcaacaacctgcactggtatcagcagaagtcccacgagagccccagactgctgattaagaacgccagccagtctatcagcggcatccccagcaagtttagcggctctggcagcggcaccgacttcaccctgagaatcaacagcgtggaaaccgaggacttcgggatgtacttctgccagcagagcaatagctggccctacacatttggctccggcaccaagctggaaatcaaaggcggaggcggaagtggaggcggaggatctggcggcggaggctctcaagtgaagctgcaacagagcggacccgagctggttaagccaggcgcttccgtgaagattagctgcaaggccagcggctacagcttcaccggctactacatgcactgggtcaagcagagccacggcaacatcctggactggatcggctacatctacccctacaacggcgtgtccagctacaaccagaagttcaagggcaaagccactctgaccgtggacaagagcagcagcaccgcctacatggaactgagaagcctgaccagcgaggacagcgccgtgtactattgtgccagagagcggggcctgtaccagctcagagcaatggattattggggccagggcaccagcgtgaccgtttcttctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3801 - DNA, 1695 bp, Artificial Sequence
  Synthetic Polynucleotide encoding a Bispecific antibody
atggccttaccagtgaccgccttgctcctgccgctggccttgctgctccacgccgccaggccggacatcgtgatgacacagacccctgccatcatgagcgcctctccaggccagaaagtgaccatcacatgtagcgccagcagcagcgtgaactacatgcactggtatcagcagaagctgggcagcagccccaagctgtggatctacgataccagcaaactggcccctggcgtgccagccagattttctggttctggcagcggcaccagctacagcctgacaatcagcagcatggaagccgaggatgccgccagctacttctgccatcagtggtctagctacccctacacctttggctccggcaccaagctggaaatcaaaggcggaggcggaagtggaggcggaggatctggcggcggaggctctgaagttcagctccaagagtctggccccgacctggtcaagcctagccaaagcctgagcctgacctgtaccgtgaccggctacagcatcacaagcggctatggatggcactggatcagacagttccccggcaacaaactggaatggatgggctacatccactacagcggcagcaccacctacaatcccagcctgaagtcccggatcagcatcagcagagacaccagcaagaaccagttcttcctgcaactgaacagcgtgaccaccgaggacaccgccacctactattgtgctcggagcctgagatattggggccagggcacaaccctgaccgtgtcatctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3802 - DNA, 1704 bp, Artificial Sequence
  Synthetic Polynucleotide encoding a Bispecific antibody
atggccttaccagtgaccgccttgctcctgccgctggccttgctgctccacgccgccaggccggacatccagatgacacagagccctagcagcctgtctgccagcgtgggagacagagtgaccatcacctgtagcgccaccagcagcatcagctacatgcactggtatcagcagaagcccggcaaggcccctaaaggctggatctacgataccagcaaactggcccacggcgtgcccagcagattttctggttctggcagcggcaccgacttcaccctgacaatatctagcctccagcctgaggacttcgccacctactactgccaccagagaagaagctaccccttcaccttcggccagggcaccaaggtggaaatcaaaggcggaggcggaagtggaggcggaggatctggcggcggaggctctgaagtgcaactggttcagagcggagccgaagtgaagaaacctggggcctctgtgaaggtgtcctgcaaggcttccggctacacctttaccaatttctggattcactgggtccgacaggctccaggccaaggactggaatggatcggagagatcgaccccagcgacagctacaccaactacaaccagaaattcaaaggccgggtcaccatcaccagagacaccagcacaagcaccgcctacctggaactgagcagcctgagaagcgaggacaccgccgtgtactactgcgccagggaaatcaccaccgtggattattggggccagggaaccctggtcaccgtgtcatctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3803 - DNA, 1725 bp, Artificial Sequence
  Synthetic Polynucleotide encoding a Bispecific antibody
atggccttaccagtgaccgccttgctcctgccgctggccttgctgctccacgccgccaggccggacatccagatgacacagagccctagcagcctgtctgccagcgtgggagacagagtgaccatcacatgcaaggccagccagggcttcaacaaatacgtggcctggtatcagcagaagcccggcaaggctcctaagctgctgatctactacaccagcacactccagcctggcgtgcccagcagattttctggctctggcagcggcagagactacaccctgacaatatccagcctccagccagaggacttcgccacctactactgtctccagtacggcaacctgctgtacgcctttggacagggcaccaaggtggaaatcaagagaggcggaggcggaagtggaggcggaggatctggcggcggaggctctgaagttcagcttgtgcagagcggagccgaagtgaagaaacctggggcctctgtgaaggtgtcctgcaaagccagcggctacacctttaccagctactggatcggctgggtccgacaggctcctggacaaggactggaatggatcggcgacatctatcccggcggaggctacaccaactacaacgagaagttcaagggccgcgtgacaatcaccagagacacctctacaagcaccgcctacctggaactgagcagcctgagaagcgaggacaccgccgtgtactactgcgccagactggatggcagcagctacagaggcgctatggattcttggggccagggcacactggtcaccgtttcttctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3804 - DNA, 1737 bp, Artificial Sequence
  Synthetic Polynucleotide encoding a Bispecific antibody
atggccttaccagtgaccgccttgctcctgccgctggccttgctgctccacgccgccaggccggacatccagctcacacagagcccttctagcctgtctgccagcgtgggcgacagagtgaccatcacatgtagagccagccagagcgtggactacgacggcgacagctacatgaactggtatcagcagaagcccggcaaggcccctaagctgctgatctacgccgccagctatctggaaagcggcgtgccaagcagattttccggctctggcagcggcaccgatttcaccctgacaatatccagcctccagcctgaggacttcgccacctactactgccagcagagccatgaggacccctacacctttggacagggcaccaaggtggaaatcaagagaggcggaggcggaagtggaggcggaggatctggcggcggaggctctgaagtgcaactggttgaatctggcggcggactggttcagcctggcggatctctgagactgagctgtgccgtgtctggctacagcatcaccagcggctactcttggaactggatcagacaggcccctggcaaaggactggaatgggtcgcctccatcacctacgatggcagcaccaactacaaccccagcgtgaagggcagaatcaccatcagcagggacgacagcaagaacaccttctacctgcaaatgaacagcctgagagccgaggacaccgccgtgtactattgtgccagaggcagccactacttcggccactggcattttgctgtgtggggccagggaaccctggtcacagtttcttctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3805 - DNA, 1713 bp, Artificial Sequence
  Synthetic Polynucleotide encoding a Bispecific antibody
atggccttaccagtgaccgccttgctcctgccgctggccttgctgctccacgccgccaggccggacatccagatgacacagagccctagcagcctgtctgccagcgtgggagacagagtgaccatcacctgtagagccagccaggacatccggtactacctgaactggtatcagcagaagcccggcaaggcccctaagctgctgatctatgtggcctccagcctccagagcggagtgccttctagattttctggcagcggctccggcaccgagtttaccctgacagtgtctagcttgcagcccgaggacttcgccacctactactgcctgcaagtgtacagcacccctcggacctttggacagggcaccaaggtggaaatcaaaggcggaggcggaagtggaggcggaggatctggcggcggaggctctgaagtgcagcttgttgaatctggcggcggactggctaagcctggcggatctctgagactgtcttgtgccgccagcggcttccggttcaccttcaacaactactacatggactgggtccgacaggcccctggacaaggacttgaatgggtgtccagaatcagcagcagcggcgaccctacttggtacgccgattctgtgaagggcagattcaccatcagcagagagaacgccaagaacaccctgttcctccagatgaactccctgagagccgaggacaccgccgtgtactattgtgcctctctgaccaccggcagcgattcttggggacagggcgtgctggttaccgtgtcatctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3806 - DNA, 1716 bp, Artificial Sequence
  Synthetic Polynucleotide encoding a Bispecific antibody
atggccttaccagtgaccgccttgctcctgccgctggccttgctgctccacgccgccaggccggagatcgtgatgacacagagccccgccacactgagtgtgtctccaggcgaaagagccacactgtcctgtagagccagccagagcgtgtccagaaacctggcctggtatcagcagaagcctggacaggctccccggctgttgatctacggcgcttctacaagagccaccggcattcccgccagattttctggctctggcagcggcaccgagttcaccctgacaatcggaagcctccagagcgaggacttcgccgtgtactactgccagcagtacaagacctggcctcggacctttggacagggcaccaacgtggaaatcaaaggcggaggcggaagtggaggcggaggatctggcggcggaggctctcaagttcagctgcaacaatggggagccggcctgctgaagcctagcgaaacactgtctctgacctgcgccgtgttcggcggctctttcagcggctactactggtcctggatcagacagcctcctggcaaaggactggaatggatcggcgagatcaaccaccggggcaacaccaacgacaaccccagcctgaaaagcagagtgaccatcagcgtggacaccagcaagaaccagttcgccctgaagctgagcagcgtgacagccgctgataccgccgtgtattattgcgccagagagcggggctacacctacggcaatttcgatcactggggccagggcaccctggtcacagtttcttctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3807 - DNA, 1719 bp, Artificial Sequence
  Synthetic Polynucleotide encoding a Bispecific antibody
atggccttaccagtgaccgccttgctcctgccgctggccttgctgctccacgccgccaggccggagatcgtgatgacccctagcagcgccacactgagtgtgtctccaggcgaaagagccacactgtcctgtagagccagccagagcgtgtccagaaacctggcctggtatcagcagaagcctggacaggctccccggctgttgatctacggcgcttctacaagagccaccggcattcccgccagattttctggctctggcagcggcaccgagttcaccctgacaatctctagcctccagagcgaggacttcgccgtgtactactgccaccagtacagcaactggatgtgcagcttcggccagggcaccaagctggaaatcaaaggcggaggcggaagtggaggcggaggatctggcggcggaggctctgaagttcagctccttgagtcaggtggcggcctggttcaacctggcggatctctgagactgagctgtgccgccagcggcttcacctttagcagatacgccatgaactgggtccgacaggcccctggcaaaggactggaatgggtgtccggcatctctggaagcggcggcagaacctactacgccgattctgtgaagggcagattcaccatcagccgggacaacagcaagaacaccctgtacctccagatgaacagcctgagagccgaggacacagccgtgtattattgcgccaaggaccgggacttttggagcggcccttttgactattggggccagggaaccctggtcaccgttagctctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3808 - DNA, 1719 bp, Artificial Sequence; identical to SEQ ID NO: 3807
  Synthetic Polynucleotide encoding a Bispecific antibody

SEQ ID NO: 3809 - DNA, 1725 bp, Artificial Sequence
  Synthetic Polynucleotide encoding a Bispecific antibody
atggccttaccagtgaccgccttgctcctgccgctggccttgctgctccacgccgccaggccgcaggttcagctccagcagtctgatgccgagctggtcaagcctggcagcagcgtgaagattagctgcaaggccagcggctacaccttcaccgatcacgccatccactgggtcaagcagaagcctgagcagggcctcgaatggatcggccactttagccctggcaacaccgacatcaagtacaacgacaagttcaagggcaaagccacactgaccgtggacagaagcagcagcacagcctacatgcagctgaacagcctgaccagcgaggacagcgccgtgtacttctgcaagaccagcaccttctttttcgactactggggccagggcacaaccctgacagtttcttctggcggaggcggaagtggaggcggaggatctggcggcggaggctctgaactggttatgacacagagccccagcagcctgacagtgacagccggcgagaaagtgaccatgatctgcaagtctagccagagcctgctgaactccggcgatcagaagaactacctgacctggtatcagcagaaacccggccagcctcctaagctgctgatcttctgggccagcaccagagaaagcggcgtgcccgatagattcacaggcagcggcagcggaaccgacttcaccctgacaatcagctctgtgcaggccgaggacctggccgtgtattactgccagaacgactacagctaccctctgacctttggagccggcaccaagctggaactgaagacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3810 - DNA, 1728 bp, Artificial Sequence
  Synthetic Polynucleotide encoding a Bispecific antibody
atggccttaccagtgaccgccttgctcctgccgctggccttgctgctccacgccgccaggccggaggtgcaactggttgagtctggcggaggactggtgcagcctggaagaagcctgagactgtcttgtgccgccagcggcttcaccttcgacgattatgccatgcactgggtccgacaggcccctggcaaaggacttgaatgggtgtccggcatctcctggaacagcggctctatcggctacgccgattccgtgaagggcagattcaccatcagccgggacaacgccaagaacagcctgtacctccagatgaactccctgagagccgaggacacagccctgtactactgcgccaaagacaaaggcggaggctactacgacttttggagcggcagcgattattggggccagggcacactggtcacagtgtctagcggcggaggcggaagtggaggcggaggatctggcggcggaggctcttcttctgagctgacacaggaccctgccgtgtctgttgctctgggccagacagtgcggattacctgtcagggcgatagcctgagaagctactacgcctcctggtatcagcagaagccaggccaggctcctgtgctggtcatctacggcaagaacaacagacccagcggcatccccgatagattcagcggaagcagctctggcaataccgccagcctgacaattactggcgctcaggccgaggacgaggccgactactactgcaacagcagagatagcagcggctgggttttcggcggaggcacaaaactgacagtgctgacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3811 - DNA, 1755 bp, Artificial Sequence
  Synthetic Polynucleotide encoding a Bispecific antibody
atggccttaccagtgaccgccttgctcctgccgctggccttgctgctccacgccgccaggccggaagtgcagctccagcagtctggacctggcctggttaagcctagccagacactgagcctgacctgtgccatcagcggcgatagcgtgctgagcaacagcgacacctggaactggatcagacagagccctagcagaggactggaatggctgggcagaacctaccacagaagcacttggtacgacgactacgccagctctgtgcggggcagagtgtccatcaatgtggacaccagcaagaaccagtacagcctgcaactgaacgccgtgacacctgaggataccggcgtgtactactgcgccagagacagactccaggacggcaactcttggagcgacgcctttgatgtgtggggccagggcacaatggtcaccgtttctagcggcggaggcggaagtggaggcggaggatctggcggcggaggctctcaatctgctctgacacagcctgccagcgtgtcaggatctcctggacagagcatcaccatctcttgcaccggcaccagctctgatgtcggcggctacaattacgtgtcctggtatcagcagcaccccggcaaggcccctaagctgatgatctacgacgtgtccaacagacccagcggcgtgtccaatagattctccggcagcaagagcggcaacaccgccagcctgacaatttctggactgcaagccgaggacgaggccgactactactgtagcagctacaccagcagcagcacactggtgtacgtgttcggcacaggcaccaaagtgaccgtgcttacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3812 - DNA, 1749 bp, Artificial Sequence
  Synthetic Polynucleotide encoding a Bispecific antibody
atggccttaccagtgaccgccttgctcctgccgctggccttgctgctccacgccgccaggccgcaggtgcaactggttcagtctggggccgaagtgaagaaacctggggcctctgtgaaggtgtcctgcaaggcttccggctacacctttaccagctacgacatcaactgggtccgacaggccacaggccaaggactggaatggatgggctggatgaaccccaacagcggcaataccggctacgcccagaaattccagggcagagtgaccatgaccagaaacaccagcatcagcaccgcctacatggaactgagcagcctgagaagcgaggacaccgccgtgtactattgcgccagaggcgacagcaactactggtcctactacggcatggacgtgtggggccagggaacactggttacagtttctagcggcggaggcggaagtggaggcggaggatctggcggcggaggctctggcggtggtggatctcaatctgtgctgacccagcctagatccgtgtctggctctcctggacagagcgtgaccatctcttgtaccggcaccagctctgatgtcggcggctacaattacgtgtcctggtatcagcagcaccccggcgaagcccctaagctgattatctacgacgccgacaagcggcccagcggcatcagcaatagattcagctctggcaagagcggcaacaccgccagcctgacaatcagcggactccaggtggaagatgaggccgactactactgctgctcctatgccggcggaagcacctgggttttcggaggcggtacaaaagtgaccgtgctgacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3813 - DNA, 1755 bp, Artificial Sequence
  Synthetic Polynucleotide encoding a Bispecific antibody
atggccttaccagtgaccgccttgctcctgccgctggccttgctgctccacgccgccaggccggaagtgcagctccagcagtctggacctggcctggttaagcctagccagacactgagcctgacctgtgccatcagcggcgatagcgtgtcctctaatagcgccgcctggaactggatcagacagagccctagcagaggactggaatggctgggcagaacctactaccgcagcaagtggtacagcgactacgccgtgtccgtgaagtcccggatcaccatcaatcccgacaccagcaagaaccagttcagcctgcaactgaacagcgtgacccctgaggataccgccgtgtactactgcgccagagatccctacgacttttggagcggctaccccgacgcctttgacatctggggacagggcacaatggtcaccgtttctagcggcggaggcggaagtggaggcggaggatctggcggcggaggctctcaatctgctctgacacagcctgccagcgtgtcaggatctcctggacagagcatcaccatctcttgcaccggcaccagctctgatgtcggcggctacaattacgtgtcctggtatcagcagcaccccggcaaggcccctaaagtgattatcagcgaagtgaacaacagacccagcggcgtgtcccacagattcagcggctctaagtctggcaacaccgccagcctgacaatctctggactgcaagccgaggacgaggccgactacttctgtagcagctacaccagcggcagaaccctgtacgtgttcggcacaggcagcaaagtgacagtgctgggaacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3814 - DNA, 1752 bp, Artificial Sequence
  Synthetic Polynucleotide encoding a Bispecific antibody
atggccttaccagtgaccgccttgctcctgccgctggccttgctgctccacgccgccaggccggaagtgcagctccagcagtctggacctggcctggttaagcctagccagacactgagcctgacctgtgccatcagcggcgattccatgctgagcaacagcgacacctggaactggatcagacagagccccagcagaggcctggaatggctgggcagaacataccacagaagcacttggtacgacgactacgccagctctgtgcggggcagagtgtccatcaatgtggacaccagcaagaaccagtacagcctgcaactgaacgccgtgacacctgaggataccggcgtgtactactgtgccagagtgcggctccaggacggcaattcttggagcgacgcctttgatgtgtggggccagggcacaatggtcaccgtttctagcggcggaggcggaagtggaggcggaggatctggcggcggaggctctcaatctgctctgacacagcctgccagcgcctctggatctcctggacagagcgtgaccatctcctgtaccggcacctcttctgatgtcggcggctacaactacgtgtcctggtatcagcagcaccccggcaaggcccctaagctgatgatctacgacgtgtccaacagacccagcggcgtgtccaatagattctccggcagcaagagcggcaacaccgccagcctgacaatttctggactgcaagccgaggacgaggccgactactactgtagcagctacaccagcagcagcacactgtacgtgttcggcacaggcacccagctcacagttcttacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3815 - DNA, 1713 bp, Artificial Sequence
  Synthetic Polynucleotide encoding a Bispecific antibody
atggccttaccagtgaccgccttgctcctgccgctggccttgctgctccacgccgccaggccggacgtggtcatgacacagagcccttctagcctgtctgccagcgtgggcgacagagtgaccatcacctgtatggcctccgaggacatctacatccggctggcctggtatcagcagaagcctggaaacgcccctaagctgctgatctacgccgccacctctctggaaacaggcgtgccaagcagattttccggcagcggctctggcaccgatttcaccctgacaatatccagcctccagcctgaggacttcgccacctactactgccagcagtattggagcagcccctggacatttggcggaggcaccaaggtggaaatcaaaggcggaggcggaagtggaggcggaggatctggcggcggaggctctcaggttcagctgcaagagtctggccccggactggtcaagcctagccaaacactgagcctgacctgtaccgtgtccggctacagcatcaccagcgactacacctggaactggatcagacagcctcctggcaacggactggaatggatcggctacatcacctacagcggcagcaccagctacaaccccagcctgaaaagccgggtgctgatctccgtggacaccagcaagaatcaggtgtccctgaagctgagcagcgtgacagccgctgataccgccgtgtactactgtgccagactggggagaagatacacaatggactactggggccagggcaccaccgtgacagtttcttctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3816 - DNA, 1725 bp, Artificial Sequence
  Synthetic Polynucleotide encoding a Bispecific antibody
atggccttaccagtgaccgccttgctcctgccgctggccttgctgctccacgccgccaggccggagatcgtgctgacacagtctcccgccacactgtcactgtctccaggcgaaagagccacactgagctgtagcgccagcagcagcgtgtcctacatgtactggtatcagcagaagcccggacaggcccctagactgctgatctacagaaccagcaacctggcctctggcatccccgccagattttctggctctggcagcggcaccgatttcaccctgaccataagcagcctggaacctgaggacttcgccgtgtactactgccagcagtaccacagctaccccaccacctttggacagggcaccaaggtggaaatcaagcggacagttggcggaggcggaagtggaggcggaggatctggcggcggaggctctgaagtgcagctggttgaatcaggtggcggcctggttcaacctggcggatctctgagactgtcttgtgccgccagcggcttcagcttcaacacctacgccatgaactgggtccgacaggctcctggcaaaggactggaatgggtgtcccacatcagaagcaagagcaacaacttcgccacctactacgccgacagcgtgaaggacagattcaccatcagccgggacaacgccaagaacagcctgtacctccagatgaactccctgagagccgaggacaccgccgtgtattattgcgccagacaaggcggcgacttccctatggattattggggccagggcaccctggtcaccgtttcttctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3817 - DNA, 1713 bp, Artificial Sequence
  Synthetic Polynucleotide encoding a Bispecific antibody
atggccttaccagtgaccgccttgctcctgccgctggccttgctgctccacgccgccaggccggacgtggtcatgacacagagcccttctagcctgtctgccagcgtgggcgacagagtgaccatcacctgtaaagccagcgaggacatctacatccggctggcctggtatcagcagaagcctggaaaggcccctaagctgctgatctacgccgccacctctctggaaacaggcgtgccaagcagattttccggcagcggctctggcaccgatttcaccctgacaatatccagcctccagcctgaggacttcgccacctactactgccagcagtattggaccacaccttggacctttggcggaggcaccaaggtggaaatcaaaggcggaggcggaagtggaggcggaggatctggcggcggaggctctcaggtgcagctccaagagtctggccctggactggtcaagcctagccagacactgagcctgacctgtaccgtgtccggctacagcatcaccatcgactacacctggaactggatcagacagcctcctggcaaaggactggaatggatcggctacatcacctacagcggcagcaccgactacaaccccagcctgaaaagccgggtgctgatctccgtggacaccagcaagaatcaggtgtccctgaagctgagcagcgtgacagccgctgataccgccgtgtactactgtgccagactgggcagaagatacgccctggattattggggccagggcaccaccgtgacagtgtcatctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3818 - DNA, 1719 bp, Artificial Sequence
  Synthetic Polynucleotide encoding a Bispecific antibody
atggccttaccagtgaccgccttgctcctgccgctggccttgctgctccacgccgccaggccggacgtggtcatgacacagagcccttctagcctgtctgccagcgtgggcgacagagtgaccatcacatgtagagccagccaggacatcagcaagtacctgaactggtatcagcagaagcccggcaaggcccctaagctgctgatctaccacaccagcagactgcacagcggcgtgccaagcagattttctggcagcggctctggcaccgacttcaccctgacaatatccagcctccagcctgaggacttcgccacctactattgccagcagggcaacaccctgccttacacctttggcggcggaacaaaggtggaaatcaaaggcggaggcggaagtggaggcggaggatctggcggcggaggctctcaagttcagctgcaagagtctggccctggcctggtcaagcctagccaaacactgagcctgacctgtaccgtcagcggagtgtccctgcctgattatggcgtgtcctggatcagacagcctcctggcaaaggactggaatggatcggcgtgatctggggcagcgagacaacctactacaacagcgccctgaagtccagagtgctgatctccgtggacaccagcaagaaccaggtgtccctgaagctgagcagcgtgacagccgctgataccgccgtgtactactgcgccagacactactactacggcggcagctacgctatggactattggggccagggcaccaccgtgacagtctcttctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3819 - DNA, 1740 bp, Artificial Sequence
  Synthetic Polynucleotide encoding a Bispecific antibody
atggccttaccagtgaccgccttgctcctgccgctggccttgctgctccacgccgccaggccggagatcgtgctgacacagtctcccgccacactgtcactgtctccaggcgaaagagccacactgagctgtagagccagccagagcgtgtccatctacctggcctggtatcagcagaagcctggacaggctccccggctgctgatctacgatgccagcaatagagccacaggcatccccgccagattttctggctctggcagcggcaccgatttcaccctgaccataagcagcctggaacctgaggacttcgccgtgtactactgccagcagagaagcaactggcctcctttcacattcggccctggcaccaaggtggacatcaaaggcggaggcggaagtggaggcggaggatctggcggcggaggctctcaggtgcagcttgttgaaagcggaggcggagttgtgcagcctggcagaagtctgagactgtcttgtgccgccagcggcttcaccttcagcagctatggaatgcactgggtccgacaggcccctggcaaaggacttgaatgggttgccgtgatctgggacgacggcagcaacaagtattacgtggacagcgtgaagggcagattcaccatcagccgggacaacagcaagaacaccctgtacctccagatgaacagcctgagagccgaggacacagccgtgtattattgcgccagagatgactactacggcagcggctccttcaacagctactatggcacagacgtgtggggccagggcacaacagttaccgttagctctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3820 - DNA, 1695 bp, Artificial Sequence
  Synthetic Polynucleotide encoding a Bispecific antibody
atggccttaccagtgaccgccttgctcctgccgctggccttgctgctccacgccgccaggccggacatccagatgacacagagccctagcagcctgtctgccagcgtgggagacagagtgaccatcacctgtagagccagccagggcatctcttcttggctggcctggtatcagcagaagcccgagaaggcccctaagagcctgatctatgccgccagctctctccagagcggagtgcctagcagattttctggcagcggctccggcaccgatttcaccctgacaatatccagcctccagcctgaggacttcgccacctactactgccagcagtacaacagctacccctacaccttcggccagggcaccaagctggaaatcaaaggcggaggcggaagtggaggcggaggatctggcggcggaggctctgaagtgcaactggttcaatctggcggcggactggttcatccaggcggttctctgagactgagctgtgccggctctggcttcaccttcagcacctacctgatgtactgggtccgacaggcccctggcaagacactggaatgggtgtccgctattggcagcggaggcgatacctactacgccgactctgtgaagggcagattcaccatcagccgggacaacgccaagaacagcctgtacctccagatgaactccctgagagccgaggacatggccgtgtactactgtgccagaggactcggctattggggccagggaacactggtcacagtgtcctctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3821 - DNA, 1707 bp, Artificial Sequence
  Synthetic Polynucleotide encoding a Bispecific antibody
atggccttaccagtgaccgccttgctcctgccgctggccttgctgctccacgccgccaggccgcagatcgtgctgacacagagccctgccatcatgtccgcttctcccggcgagaaagtgaccatcacatgtagcgccagcagcagcgtgtcctacatgcactggttccagcagaagcccggcacaagccctaagctgtggatctacagcaccagcaatctggcctctggcgtgccagccagattttctggctctggcagcggcaccagctacagcctgacaatcagcagaatggaagccgaggacgccgccacctactactgtcagcagagaagcagctaccctcctacctttggcggaggcaccaagctggaaatcaaaggcggaggcggaagtggaggcggaggatctggcggcggaggctctcaggttcagctccagcagagcggagccgagcttatgaagcctggcgcttccgtgaagatcagctgcaaggccaccggctacaccttcagcagctactggatcgagtgggtcaagcagaggcccggacatggcctggaatggatcggagagatcctgcctggaagcggcagcaccaactacaacgagaagttcaagggcaaagccaccttcaccgccgacaccagcagcaacacagcctatatgcagctgagcagcctgaccagcgaggacagcgccgtgtactactgcgccagatacgactacccttggtttgcctattggggccagggcaccctggttacagtttctgctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3822 - DNA, 1731 bp, Artificial Sequence
  Synthetic Polynucleotide encoding a Bispecific antibody
atggccttaccagtgaccgccttgctcctgccgctggccttgctgctccacgccgccaggccggacatcgtgatgacacagagccctagcagcctgacagtgacagccggcgagaaagtgaccatgagctgcaagagcagccagagcctgctgaacagcggcaaccagaagaactacctgacctggtatcagcagaagcccggccagcctcctaagctgctgatctactgggccagcaccagagaaagcggcgtgcccgatagattcacaggcagcggcagcggaaccgacttcaccctgacaatcagctctgtgcaggccgaggatctggccgtgtactactgccagaacgactacagctaccccttcacctttggctccggcaccaagctggaaatcaaaggcggaggcggaagtggaggcggaggatctggcggcggaggctctcaagttcagctgcaacagcctggggccgaactcgttagacctggcgcttctgtgaagctgtcctgcaaggccagcggctacacctttaccagctactggatcaactgggtcaagcagcggcctggacagggcctcgaatggatcggcaatatctaccccagcgacagctacaccaactacaatcagaagttcaaggacaaggccacactgaccgtggacaagtctagcagcaccgcctacatgcagctgagcagccctacaagcgaggacagcgccgtgtattattgcacccggtcttggcggggcaacagcttcgattattggggccagggcacaaccctgaccgtgtcatctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3823 - DNA, 1725 bp, Artificial Sequence
  Synthetic Polynucleotide encoding a Bispecific antibody
atggccttaccagtgaccgccttgctcctgccgctggccttgctgctccacgccgccaggccggacacccagatgacacagagccctagtagcgtgtccgccagcgtgggagacagagtgaccatcacctgtagaaccagccaggacatcagcaactacctgaactggtatcagcagaagcccggcaaggcccctaagctgctgatctacaacaccagcagactgcacagcggcgtgcccagcagattttctggctctggcagcggcaccgacttcaccctgacaatatctagcctccagcctgaggacttcgccacctactactgccagcagagcaacatgttcccctacaccttcggccagggcaccaagctggaaatcaaaggcggaggcggaagtggaggcggaggatctggcggcggaggctctcaagttcagctggttcagagcggagccgaagtgaagaaacctggggcctctgtgaaggtgtcctgcaaggcttccggctacacctttaacggctacttcatgaactgggtccgacaggctcctggacagggcctcgaaagaatgggcagaatcaaccccaacaacggcgacagcttctacaaccagaaattccagggccgcgtgaccatgaccagagacaccagcacaagcaccgtgtacatggaactgcctagcctgagaagcgaggacaccgccgtgtactactgtgccagagagggctattacggcggcagaggctacgccctggattattggggacagggcacactggtcaccgtgtctagtacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3824 - DNA, 1728 bp, Artificial Sequence
  Synthetic Polynucleotide encoding a Bispecific antibody
atggccttaccagtgaccgccttgctcctgccgctggccttgctgctccacgccgccaggccggacatccagctgactcagagccctagctttctgagcgccagcgtgggcgacagagtgaccattacatgtagagccagccagggcatcagcaccgacctgaactggtatcagcagaagcctggcaaggcccctaagctgctgatctacgccgccagcaatctggaaagcggcgtgccaagcagattttccggctctggcagcggcaccgagttcaccctgacaatatctagcctccagcctgaggacttcgccacctactactgccagcagagctacaactggccctacacctttggcggaggcaccaaggtggaaatcaagagaggcggaggcggaagtggaggcggaggatctggcggcggaggctctgaagttcagctggttgaatcaggcggaggactcgtgaaacctggcggctctctgagactgtcttgtgccgccagcggcttcaccttcagcaacttcgagatgaactgggtccgacaggccccaggcaaaggactggaatgggtgtccggcatcagctccaatggccggtacatcaactacgccgacagcgtgaagggcagattcaccatcagccgggacaacgccaagaacagcctgtacctccagatgaactccctgagagccgaggacaccgccgtgtactattgtgccagagtggtggacttcgaccaggactacaacggcttcgactattggggccagggcaccctggttaccgttagctctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3825 - DNA, 1722 bp, Artificial Sequence
  Synthetic Polynucleotide encoding a Bispecific antibody
atggccttaccagtgaccgccttgctcctgccgctggccttgctgctccacgccgccaggccggacatccaactgactcagagccccagctttctgagcgcctctgtgggcgacagagtgaccatcacatgtagtctcagcctgggcatcagcacatggcgggattggtttccgccgaggcttggcaggggccttgagccgctgacctacgccgccagcacactgcaaagcggagtgcctagcagattttccggcagcggctctggcaccgagttcaccctgacaatatccagcctccagcctgaggacttcgccacctactactgccagcagctcaacagctaccctctgacctttggcggaggcaccaaggtggaaatcaagagaggcggaggcggaagtggaggcggaggatctggcggcggaggctctgaagttcaactggttgagtctggtggcggcctggttaagcctggcggatctctgagactgagctgtgccgccagcggcttcacctttagcacatacggcatgagctgggtccgacaggcccctggaaaaggacttgagtgggtcgcctacatcaacaacggctccggctacatctactacgccgacagcgtgaagggcagattcaccatcagccgggacaacgccaagaacagcctgtacctccagatgaactccctgagagccgaggacaccgccgtgtactattgtgccagaggacagtggtggagcggcggagactttgattattggggccagggcaccctggtcaccgtttcttctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3826 - DNA, 1731 bp, Artificial Sequence
  Synthetic Polynucleotide encoding a Bispecific antibody
atggccttaccagtgaccgccttgctcctgccgctggccttgctgctccacgccgccaggccggagctggtcatgacacagagccctgcttctctggccgtgtcactgggacagagagccaccatctcttgcagagccagcgagagcgtggacagctacggcaagagcttcatgcactggtatcagctcaagcccggccagcctcctaagctgctgatctacagagcctccaacctggaaagcggcgtgccagccagattttctggcagcggcagcagaaccgacttcaccctgaccattgatcccgtggaagccgatgatgccgccacctactactgccagcagaacaacgaggacccctggacatttggcggaggcaccaagctggaaatcaaaggcggaggcggaagtggaggcggaggatctggcggcggaggctctgaagtgcagctcgaacagtctggccccgagcttgtgaaacctggcgcttccgtgaagatgagctgcaaggccagcggctacaccttcaccaactactacatgaaatgggtcaagcagagccacggcaagtccctggaatggatcggcgatctgaaccccaacaacggcgacaccttctacaaccagaagttcaagggcaaagccacactgaccgtggacaagagcagcaacaccgcctacatgcagctcaactccctgaccagcgaggacagcgccgtgtactactgtgccagaaccggcagatacgaagagaacgctatggactactggggccagggcacaagcgtgacagtctcttctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3827 - DNA, 1722 bp, Artificial Sequence
  Synthetic Polynucleotide encoding a Bispecific antibody
atggccttaccagtgaccgccttgctcctgccgctggccttgctgctccacgccgccaggccgcagtctgtggtcacacagcctccatccgtgtctgctgcccctggacagaaagtgaccatcagctgtagcggcagcagcagcaacatcggcaacaactacgtgtcctggtatcagcagctgcccggcacagctcccaaactgctgatctacgacaacaacaagcggcccagcggcatccccgatagattttctgccagcaagagcggcaccagcgccacactgggaatcacaggactccagaccagagatgaggccgactactactgcggcacctgggattcttctctgtccgcctgggttttcggcggaggcacaaaactgacagtgctcggaggcggaggcggaagtggaggcggaggatctggcggcggaggctctcaagttcagctggttcagtctggggccgaagtgaagaaacctggcagcagcgtgaaggtgtcctgcaaggcttccggcgataccttcagcagctactacatcagctgggtccgacaggccccaggacaaggacttgagtggatgggcagaatcatccccatcctgggaatcgccaactacgcccagaaataccagggcagagtgaccctgagcgccgacaagagcacaagcaccagctacatggaactgaacagcctgagcagcgaggacaccgccgtgtactattgtgccctggactggtcctacagcatcgactattggggccagggcaccctggtcacagtctcttctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3828 - DNA, 1722 bp, Artificial Sequence
  Synthetic Polynucleotide encoding a Bispecific antibody
atggccttaccagtgaccgccttgctcctgccgctggccttgctgctccacgccgccaggccgcagtctgtgctgacacagcctcctagtgtgtctggcgctcctggacagagagtgaccatcagctgtacaggcagcagcagcaatatcggagccggctatgacgtgcactggtatcagcagctgcctggcacagcccctaaactgctgatctacggcaacagcaacagacccagcggcgtgcccgatagattttccggctctaagagcggcacaagcgccagcctggctattactggactccaggccgaggacgaggccgactactactgtcagagctacgacagcagcctgagcggctctgtgtttggcacaggcacaaaggtgctggtgcttggcggaggcggaagtggaggcggaggatctggcggcggaggctctcaagttcagctggttcagagcggagccgaagtgaagaaacctggcagcagcgtgaaggtgtcctgcaaagcaagcggcggcaccttcagcagctacaccatcaacgtttggagacaggccccaggccagggccttgaatggatgggaggcttcatccctatcagcggcaccgtgaactacgcccagaaattccagggcagagtgacaatcaccgccgacgagagcacaagcaccgcctacatggaactgtccagcctgagaagcgaggacaccgccgtgtactactgtgccagacctctggattggaccgaggacatctggggccagggaacactggtcacagtgtctagtacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3829 - DNA, 1731 bp, Artificial Sequence
  Synthetic Polynucleotide encoding a Bispecific antibody
atggccttaccagtgaccgccttgctcctgccgctggccttgctgctccacgccgccaggccgaacttcatgctgacccagcctcacagcgtgtccgagtctccaggcaagaccgtgaccatcagctgtacaggcagcagcggctctatcgccagcaactacgtgcagtggtatcagcagaggccaggcagcgcccctaccatcctgatctacgaggataacaagcggcctagcggcgtgcccgatagattttctggcagcatcgacagcagcagcaacagcgccagcctgacaatcagcggcctgaaaacaggcgacgaggccgactactactgccagagctacgacgacatcaaccactgggttttcggcggaggcaccaagctgacagttcttggaggcggaggcggaagtggaggcggaggatctggcggcggaggctctgaagttcagctggttcagagcggagccgaagtgaagaaacctggggcctctgtgaaggtgtcctgcaaggcttccggctacacctttaccgcctactacctgcactggctgagacaggctccaggccaaggactggaatggatgggctggatgaacaccaacaacggggccaccagatacgcccagaaattccaggacagagtgaccatgaccagagacaccagcatcaacaccgcctacatggaaatgagcggcctgtcctccgacgacaccgccatgtactattgtgccagaggcgacatcagccaggacttcgctgatgtgtggggccagggaacactggtcacagtgtcatctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3830 - DNA, 1752 bp, Artificial Sequence
  Synthetic Polynucleotide encoding a Bispecific antibody
atggccttaccagtgaccgccttgctcctgccgctggccttgctgctccacgccgccaggccggacgtgatgctgacccagacaccactgagcctgcctgtgtctctgggcgatcaggccagcatctcctgtagaagcagccagagcatcctgcacagcaccggcgatacctacctggaatggtatctccagaagcctggacagagccccaagctgctgattaacaaggtgtccaaccggctgagcggcgtgcccgatagattttctggcagcggctctggcaccgacttcaccctgaagatcagcagagtggaagccgaggacctgggcgtgtactactgcttccaaggcagccatgttccttggacctttggcggaggcaccaagctggaaatcaagagagctgacgccgctcctaccgtgtccatctttcctggaggcggtggaagtggcggcggtggttcaggcggcggaggatctcaagtgaagctccagcagagcggccctagccttgtgaaacctggcgcttccgtgaagatgagctgcaaggccagcggctacaccttcaccgatttctacatgaaatgggtcaagcagagccacggcaagtctctggaatggatcggcgacatcaaccccaacatcggagacaccttctacaaccagaagttcaagggcaaagccacactgaccgtggacaagagcagcagcaccgcctacatgcagctcaacagcctgaccagcgaggacagcgccgtgtacttttgttccgtgggctacttcgacgtgtggggagccggaacaaccgtgacagtctcttctacgcgtacgcgtggctcagcatggtctcatcctcagtttgaaaaaggtggagggtccgggggcggcagtggtggtagtgcttggtcccatccacagtttgaaaagtcgcgttcctccggaggtggtggctcccaggtgcagctggtgcagtctgggggaggcgtggtccagcctgggaggtccctgagactctcctgtaagtcttctggatacaccttcactaggtatacgatgcactgggtccgccaggctccagggaaggggctggagtggattggatacataaatcctagccgtggttatactaattataatcagaaggtgaaggaccgattcaccatctccagagacaactccaagaacacggcctttctgcaaatggacagcctgagacccgaggacacgggtgtgtatttctgtgcgagatattatgatgatcattactgccttgactactggggccagggcaccccggtcaccgtctcctcagtcgaaggtggaagtggaggttctggtggaagtggaggttcaggtggagtggacgacatccagatgacccagtctccatcctccctgtctgcatctgtaggagacagagtcaccatcacttgcagagcaagttcaagcgtaagctacatgaattggtatcagcagacaccagggaaagcccctaagagatggatctatgacacatccaaagtggcttctggggtcccatcaaggttcagtggcagtggatctgggacagattacactttcaccatcagcagtctgcaacctgaagatattgcaacttactactgtcaacagtggagtagtaaccctctcacttttggccaggggaccaagctgcagatcaccgagcagaaactgatctcggaagaggatctgtccggcggcagccatcaccaccatcaccacctcgagtag

SEQ ID NO: 3831 - DNA, 4095 bp, Artificial Sequence
  Synthetic Polynucleotide
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggtcaaggaacctcagtcaccgtctcctcacgcgtagagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatcaccatgggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgggactagaggagtgcaggtggagactatctccccaggagacgggcgcaccttccccaagcgcggccagacctgcgtggtgcactacaccgggatgcttgaagatggaaagaaagttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaagggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccaatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctaa

SEQ ID NO: 3832 - DNA, 4095 bp, Artificial Sequence
  Synthetic Polynucleotide
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggtcaaggaacctcagtcaccgtctcctcacgcgtagagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatcaccatgggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgggactagaggagtgcaggtggagactatctccccaggagacgggcgcaccttccccaagcgcggccagacctgcgtggtgcactacaccgggatgcttgaagatggaaagaaagttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaagggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccaaacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccaatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctaa

SEQ ID NO: 3833 - DNA, 3591 bp, Artificial Sequence; identical to SEQ ID NO: 1007
  Synthetic Polynucleotide

SEQ ID NO: 3834 - DNA, 2568 bp, Artificial Sequence
  Synthetic Polynucleotide
atggccttaccagtgaccgccttgctcctgccgctggccttgctgctccacgccgccaggccggacgtggtcatgacacagagcccttctagcctgtctgccagcgtgggcgacagagtgaccatcacctgtatggcctccgaggacatctacatccggctggcctggtatcagcagaagcctggaaacgcccctaagctgctgatctacgccgccacctctctggaaacaggcgtgccaagcagattttccggcagcggctctggcaccgatttcaccctgacaatatccagcctccagcctgaggacttcgccacctactactgccagcagtattggagcagcccctggacatttggcggaggcaccaaggtggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctgcaagagtctggccccggactggtcaagcctagccaaacactgagcctgacctgtaccgtgtccggctacagcatcaccagcgactacacctggaactggatcagacagcctcctggcaacggactggaatggatcggctacatcacctacagcggcagcaccagctacaaccccagcctgaaaagccgggtgctgatctccgtggacaccagcaagaatcaggtgtccctgaagctgagcagcgtgacagccgctgataccgccgtgtactactgtgccagactggggagaagatacacaatggactactggggccagggcaccaccgtgacagtttcttctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3835 - DNA, 2646 bp, Artificial Sequence
  Synthetic Polynucleotide
atggccttaccagtgaccgccttgctcctgccgctggccttgctgctccacgccgccaggccggagatcgtgctgacacagtctcccgccacactgtcactgtctccaggcgaaagagccacactgagctgtagcgccagcagcagcgtgtcctacatgtactggtatcagcagaagcccggacaggcccctagactgctgatctacagaaccagcaacctggcctctggcatccccgccagattttctggctctggcagcggcaccgatttcaccctgaccataagcagcctggaacctgaggacttcgccgtgtactactgccagcagtaccacagctaccccaccacctttggacagggcaccaaggtggaaatcaagcggacagttctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctggttgaatcaggtggcggcctggttcaacctggcggatctctgagactgtcttgtgccgccagcggcttcagcttcaacacctacgccatgaactgggtccgacaggctcctggcaaaggactggaatgggtgtcccacatcagaagcaagagcaacaacttcgccacctactacgccgacagcgtgaaggacagattcaccatcagccgggacaacgccaagaacagcctgtacctccagatgaactccctgagagccgaggacaccgccgtgtattattgcgccagacaaggcggcgacttccctatggattattggggccagggcaccctggtcaccgtttcttctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3836 - DNA, 2568 bp, Artificial Sequence
  Synthetic Polynucleotide
atggccttaccagtgaccgccttgctcctgccgctggccttgctgctccacgccgccaggccggacacccagatgacacagagccctagtagcgtgtccgccagcgtgggagacagagtgaccatcacctgtagaaccagccaggacatcagcaactacctgaactggtatcagcagaagcccggcaaggcccctaagctgctgatctacaacaccagcagactgcacagcggcgtgcccagcagattttctggctctggcagcggcaccgacttcaccctgacaatatctagcctccagcctgaggacttcgccacctactactgccagcagagcaacatgttcccctacaccttcggccagggcaccaagctggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctggttcagagcggagccgaagtgaagaaacctggggcctctgtgaaggtgtcctgcaaggcttccggctacacctttaacggctacttcatgaactgggtccgacaggctcctggacagggcctcgaaagaatgggcagaatcaaccccaacaacggcgacagcttctacaaccagaaattccagggccgcgtgaccatgaccagagacaccagcacaagcaccgtgtacatggaactgcctagcctgagaagcgaggacaccgccgtgtactactgtgccagagagggctattacggcggcagaggctacgccctggattattggggacagggcacactggtcaccgtgtctagtacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggacgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3837 - DNA, 7488 bp, Artificial Sequence
  Synthetic Polynucleotide
  misc_feature (3291)..(3294): n is a, c, g, or t
aatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggttaacttttaaaagaaaaggggggattggggggtacagtgcaggggaaagaatagtagacataatagcaacagacatacaaactaaagaattacaaaaacaaattacaaaattcaaaattttatcgataagctttgcaaagatggataaagttttaaacagagaggaatctttgcagctaatggaccttctaggtcttgaaaggagtgcctcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgaccttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaggaattagcttggtactaatacgactcactatagggagacccaagctggctaggtaagcttgatatcgaattcctgcagcccgggggatctgctagcnnnngtcgactccggatgatcagggccctgtacagatatcgacaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctggaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagctt

SEQ ID NO: 3838 - DNA, 6887 bp, Artificial Sequence
  Synthetic Polynucleotide
  misc_feature (3291)..(3294): n is a, c, g, or t
aatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggttaacttttaaaagaaaaggggggattggggggtacagtgcaggggaaagaatagtagacataatagcaacagacatacaaactaaagaattacaaaaacaaattacaaaattcaaaattttatcgataagctttgcaaagatggataaagttttaaacagagaggaatctttgcagctaatggaccttctaggtcttgaaaggagtgcctcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgaccttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaggaattagcttggtactaatacgactcactatagggagacccaagctggctaggtaagcttgatatcgaattcctgcagcccgggggatctgctagcnnnngtcgacggcgaatccggactatagtgtcacctaaatgctagacgtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagctt

SEQ ID NO: 3839 - DNA, 9305 bp, Artificial Sequence
  Synthetic Polynucleotide
aatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggttaacttttaaaagaaaaggggggattggggggtacagtgcaggggaaagaatagtagacataatagcaacagacatacaaactaaagaattacaaaaacaaattacaaaattcaaaattttatcgataagctttgcaaagatggataaagttttaaacagagaggaatctttgcagctaatggaccttctaggtcttgaaaggagtgcctcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgaccttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaggaattagcttggtactaatacgactcactatagggagacccaagctggctaggtaagcttgatatcgaattcctgcagcccgggggatctgctagcatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggtcaaggaacctcagtcaccgtctcctcacgcgtagagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccccatggccaagcctttgtctcaagaagaatccaccctcattgaaagagcaacggctacaatcaacagcatccccatctctgaagactacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggcactagtggctccggcgagggcagaggaagtctactaacctgcggagatgtggaagaaaatcctggcccaatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaagtcgacggcgaatccggactatagtgtcacctaaatgctagacgtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagctt

SEQ ID NO: 3840 - DNA, 9652 bp, Artificial Sequence
  Synthetic Polynucleotide
aatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggttaacttttaaaagaaaaggggggattggggggtacagtgcaggggaaagaatagtagacataatagcaacagacatacaaactaaagaattacaaaaacaaattacaaaattcaaaattttatcgataagctttgcaaagatggataaagttttaaacagagaggaatctttgcagctaatggaccttctaggtcttgaaaggagtgcctcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgaccttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaggaattagcttggtactaatacgactcactatagggagacccaagctggctaggtaagcttgatatcgaattcctgcagcccgggggatctgctagcatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggtcaaggaacctcagtcaccgtctcctcacgcgtagagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccccatggccaagcctttgtctcaagaagaatccaccctcattgaaagagcaacggctacaatcaacagcatccccatctctgaagactacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggcactagtggctccggcgagggcagaggaagtctactaacctgcggagatgtggaagaaaatcctggcccaatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaagtcgacggcgaatccggactatagtgtcacctaaatgctagacgtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagctt

SEQ ID NO: 3841 - DNA, 1183 bp, Artificial Sequence
  Synthetic Polynucleotide
gtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgaccttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtga

SEQ ID NO: 3842 - DNA, 836 bp, Artificial Sequence
  Synthetic Polynucleotide
gtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgaccttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtga

SEQ ID NO: 3843 - DNA, 20 bp, Artificial Sequence
  Synthetic Polynucleotide
taatacgactcactataggg

SEQ ID NO: 3844 - DNA, 20 bp, Artificial Sequence
  Synthetic Polynucleotide
attaaccctcactaaaggga

SEQ ID NO: 3845 - DNA, 7566 bp, Artificial Sequence
  Synthetic Polynucleotide
tgaaagaccccacctgtaggtttggcaagctagcttaagtaacgccattttgcaaggcatggaaaatacataactgagaatagagaagttcagatcaaggttaggaacagagagacagcagaatatgggccaaacaggatatctgtggtaagcagttcctgccccggctcagggccaagaacagatggtccccagatgcggtcccgccctcagcagtttctagagaaccatcagatgtttccagggtgccccaaggacctgaaatgaccctgtgccttatttgaactaaccaatcagttcgcttctcgcttctgttcgcgcgcttctgctccccgagctcaataaaagagcccacaacccctcactcggcgcgccagtcctccgatagactgcgtcgcccgggtacccgtattcccaataaagcctcttgctgtttgcatccgaatcgtggactcgctgatccttgggagggtctcctcagattgattgactgcccacctcgggggtctttcatttggaggttccaccgagatttggagacccctgcccagggaccaccgacccccccgccgggaggtaagctggccagcggtcgtttcgtgtctgtctctgtctttgtgcgtgtttgtgccggcatctaatgtttgcgcctgcgtctgtactagttagctaactagctctgtatctggcggacccgtggtggaactgacgagttctgaacacccggccgcaaccctgggagacgtcccagggactttgggggccgtttttgtggcccgacctgaggaagggagtcgatgtggaatccgaccccgtcaggatatgtggttctggtaggagacgagaacctaaaacagttcccgcctccgtctgaatttttgctttcggtttggaaccgaagccgcgcgtcttgtctgctgcagcgctgcagcatcgttctgtgttgtctctgtctgactgtgtttctgtatttgtctgaaaattagggccagactgttaccactcccttaagtttgaccttaggtcactggaaagatgtcgagcggatcgctcacaaccagtcggtagatgtcaagaagagacgttgggttaccttctgctctgcagaatggccaacctttaacgtcggatggccgcgagacggcacctttaaccgagacctcatcacccaggttaagatcaaggtcttttcacctggcccgcatggacacccagaccaggtcccctacatcgtgacctgggaagccttggcttttgacccccctccctgggtcaagccctttgtacaccctaagcctccgcctcctcttcctccatccgccccgtctctcccccttgaacctcctcgttcgaccccgcctcgatcctccctttatccagccctcactccttctctaggcgccggaattagatccccaccatgaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacctcgagaccgatttctacccctacgatgtgcccgattacgcttagtctagagggccctattctatagtgtcacctaagtcgaggttaacgaattctaccgggtaggggaggcgcttttcccaaggcagtctggagcatgcgctttagcagccccgctgggcacttggcgctacacaagtggcctctggcctcgcacacattccacatccaccggtaggcgccaaccggctccgttctttggtggccccttcgcgccaccttctactcctcccctagtcaggaagttcccccccgccccgcagctcgcgtcgtgcaggacgtgacaaatggaagtagcacgtctcactagtctcgtgcagatggacagcaccgctgagcaatggaagcgggtaggcctttggggcagcggccaatagcagctttgctccttcgctttctgggctcagaggctgggaaggggtgggtccgggggcgggctcaggggcgggctcaggggcggggcgggcgcccgaaggtcctccggaggcccggcattctgcacgcttcaaaagcgcacgtctgccgcgctgttctcctcttcctcatctccgggcctttcgacctgcatcccgccaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccggggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagagtagatgccgaccgaacaagagctgatttcgagaacgcctcagccagcaactcgcgcgagcctagcaaggcaaatgcgagagaacggccttacgcttggtggcacagttctcgtccacagttcgctaagctcgctcggctgggtcgcgggagggccggtcgcagtgattcaggcccttctggattgtgttggtccccagggcacgattgtcatgcccacgcactcgggtgatctgactgatcccgcagattggagatcgccgcccgtgcctgccgattgggtgcagatccgtcgacctgcagccaagcttatcgataaaataaaagattttatttagtctccagaaaaaggggggaatgaaagaccccacctgtaggtttggcaagctagcttaagtaacgccattttgcaaggcatggaaaatacataactgagaatagagaagttcagatcaaggttaggaacagagagacagcagaatatgggccaaacaggatatctgtggtaagcagttcctgccccggctcagggccaagaacagatggtccccagatgcggtcccgccctcagcagtttctagagaaccatcagatgtttccagggtgccccaaggacctgaaatgaccctgtgccttatttgaactaaccaatcagttcgcttctcgcttctgttcgcgcgcttctgctccccgagctcaataaaagagcccacaacccctcactcggcgcgccagtcctccgatagactgcgtcgcccgggtacccgtgtatccaataaaccctcttgcagttgcatccgacttgtggtctcgctgttccttgggagggtctcctctgagtgattgactacccgtcagcgggggtctttcatgggtaacagtttcttgaagttggagaacaacattctgagggtaggagtcgaatattaagtaatcctgactcaattagccactgttttgaatccacatactccaatactcctgaaatagttcattatggacagcgcagaagagctggggagaattaattcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggcgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggcgattagtccaatttgttaaagacaggatatcagtggtccaggctctagttttgactcaacaatatcaccagctgaagcctatagagtacgagccatagataaaataaaagattttatttagtctccagaaaaaggggggaa

SEQ ID NO: 3846 - DNA, 6884 bp, Artificial Sequence
  Synthetic Polynucleotide
tgaaagaccccacctgtaggtttggcaagctagcttaagtaacgccattttgcaaggcatggaaaatacataactgagaatagagaagttcagatcaaggttaggaacagagagacagcagaatatgggccaaacaggatatctgtggtaagcagttcctgccccggctcagggccaagaacagatggtccccagatgcggtcccgccctcagcagtttctagagaaccatcagatgtttccagggtgccccaaggacctgaaatgaccctgtgccttatttgaactaaccaatcagttcgcttctcgcttctgttcgcgcgcttctgctccccgagctcaataaaagagcccacaacccctcactcggcgcgccagtcctccgatagactgcgtcgcccgggtacccgtattcccaataaagcctcttgctgtttgcatccgaatcgtggactcgctgatccttgggagggtctcctcagattgattgactgcccacctcgggggtctttcatttggaggttccaccgagatttggagacccctgcccagggaccaccgacccccccgccgggaggtaagctggccagcggtcgtttcgtgtctgtctctgtctttgtgcgtgtttgtgccggcatctaatgtttgcgcctgcgtctgtactagttagctaactagctctgtatctggcggacccgtggtggaactgacgagttctgaacacccggccgcaaccctgggagacgtcccagggactttgggggccgtttttgtggcccgacctgaggaagggagtcgatgtggaatccgaccccgtcaggatatgtggttctggtaggagacgagaacctaaaacagttcccgcctccgtctgaatttttgctttcggtttggaaccgaagccgcgcgtcttgtctgctgcagcgctgcagcatcgttctgtgttgtctctgtctgactgtgtttctgtatttgtctgaaaattagggccagactgttaccactcccttaagtttgaccttaggtcactggaaagatgtcgagcggatcgctcacaaccagtcggtagatgtcaagaagagacgttgggttaccttctgctctgcagaatggccaacctttaacgtcggatggccgcgagacggcacctttaaccgagacctcatcacccaggttaagatcaaggtcttttcacctggcccgcatggacacccagaccaggtcccctacatcgtgacctgggaagccttggcttttgacccccctccctgggtcaagccctttgtacaccctaagcctccgcctcctcttcctccatccgccccgtctctcccccttgaacctcctcgttcgaccccgcctcgatcctccctttatccagccctcactccttctctaggcgccggaattagatccccaccatgaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacctcgagaccgatttctacccctacgatgtgcccgattacgcttagtctagagggccctattctatagtgtcacctaagtcgaggttaacgaattctaccgggtaggggaggcgcttttcccaaggcagtctggagcatgcgctttagcagccccgctgggcacttggcgctacacaagtggcctctggcctcgcacacattccacatccaccggtaggcgccaaccggctccgttctttggtggccccttcgcgccaccttctactcctcccctagtcaggaagttcccccccgccccgcagctcgcgtcgtgcaggacgtgacaaatggaagtagcacgtctcactagtctcgtgcagatggacagcaccgctgagcaatggaagcgggtaggcctttggggcagcggccaatagcagctttgctccttcgctttctgggctcagaggctgggaaggggtgggtccgggggcgggctcaggggcgggctcaggggcggggcgggcgcccgaaggtcctccggaggcccggcattctgcacgcttcaaaagcgcacgtctgccgcgctgttctcctcttcctcatctccgggcctttcgacctgcagcccaagcttaccatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctgacgcccgccccacgacccgcagcgcccgaccgaaaggagcgcacgaccccatgcatcgataaaataaaagattttatttagtctccagaaaaaggggggaatgaaagaccccacctgtaggtttggcaagctagcttaagtaacgccattttgcaaggcatggaaaatacataactgagaatagagaagttcagatcaaggttaggaacagagagacagcagaatatgggccaaacaggatatctgtggtaagcagttcctgccccggctcagggccaagaacagatggtccccagatgcggtcccgccctcagcagtttctagagaaccatcagatgtttccagggtgccccaaggacctgaaatgaccctgtgccttatttgaactaaccaatcagttcgcttctcgcttctgttcgcgcgcttctgctccccgagctcaataaaagagcccacaacccctcactcggcgcgccagtcctccgatagactgcgtcgcccgggtacccgtgtatccaataaaccctcttgcagttgcatccgacttgtggtctcgctgttccttgggagggtctcctctgagtgattgactacccgtcagcgggggtctttcatgggtaacagtttcttgaagttggagaacaacattctgagggtaggagtcgaatattaagtaatcctgactcaattagccactgttttgaatccacatactccaatactcctgaaatagttcattatggacagcgcagaagagctggggagaattaattcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggcgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggcgattagtccaatttgttaaagacaggatatcagtggtccaggctctagttttgactcaacaatatcaccagctgaagcctatagagtacgagccatagataaaataaaagattttatttagtctccagaaaaaggggggaa

SEQ ID NO: 3847 - DNA, 7512 bp, Artificial Sequence
  Synthetic Polynucleotide
aatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgataagcttgggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgactctagaggatccccaccatggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccctatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgagttggaaggatgcctctggatggtcttaagtcgagaccgatttctacccctacgatgtgcccgattacgcttagtctagagggcccgcggttcgaaggtaagcctatccctaaccctctcctcggtctcgattctacgcgtaccggttagtaatgagtttggaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcagcacgtgttgacaattaatcatcggcatagtatatcggcatagtataatacgacaaggtgaggaactaaaccatggccaagcctttgtctcaagaagaatccaccctcattgaaagagcaacggctacaatcaacagcatccccatctctgaagactacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggctaagcacaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagctt

SEQ ID NO: 3848 - DNA, 7476 bp, Artificial Sequence
  Synthetic Polynucleotide
aatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgataagcttgggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgactctagaggatccccatggaagccgaggccgagagaggcaagctgcccggcaaaaagctgcccctggaagtgctgatcgagctggaagccaacgccagaaaggccggctgcaccagaggctgcctgatctgcctgagcaagatcaagtgcaccgccaagatgaagaagtacatccccggcagatgcgccgactacggcggcgataagaaaacaggccaggccggcatcgtgggagccatcgtggatatccctgagatcagcggcttcaaagaaatggaacccatggaacagtttatcgcccaggtggaccgctgcgccgattgcacaacaggctgtctgaagggcctggctaacgtgaagtgcagcgacctgctgaagaagtggctgcctggcagatgtgccaccttcgccgacaagatccagagcgaggtggacaacatcaagggactggccggcgacctcgagaccgatttctacgactacaaggacgacgatgacaaggattataaagatgatgacgataaagtcgagaccgatttctacgactacaaggacgacgatgacaagtagtctagagggcccgcggttcgaaggtaagcctatccctaaccctctcctcggtctcgattctacgcgtaccggttagtaatgagtttggaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcagcacgtgttgacaattaatcatcggcatagtatatcggcatagtataatacgacaaggtgaggaactaaaccatggccaagcctttgtctcaagaagaatccaccctcattgaaagagcaacggctacaatcaacagcatccccatctctgaagactacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggctaagcacaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagctt

SEQ ID NO: 3849 - DNA, 8663 bp, Artificial Sequence
  Synthetic Polynucleotide
aatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggttaacttttaaaagaaaaggggggattggggggtacagtgcaggggaaagaatagtagacataatagcaacagacatacaaactaaagaattacaaaaacaaattacaaaattcaaaattttatcgataagctttgcaaagatggataaagttttaaacagagaggaatctttgcagctaatggaccttctaggtcttgaaaggagtgcctcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgaccttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaggaattagcttggtactaatacgactcactatagggagacccaagctggctagttaagcttgatatcgaattcctgcagcccgggggatctgctagcatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgccactagtggctccggcgagggcagaggaagtctactaacctgcggagatgtggaagaaaatcctggcccacatatgaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgactaactcgactccggatgatcagggccctgtacagatatcgacaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctggaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagctt

SEQ ID NO: 3850 - DNA, 7524 bp, Artificial Sequence
  Synthetic Polynucleotide
tgaaagaccccacctgtaggtttggcaagctagcttaagtaacgccattttgcaaggcatggaaaatacataactgagaatagagaagttcagatcaaggttaggaacagagagacagcagaatatgggccaaacaggatatctgtggtaagcagttcctgccccggctcagggccaagaacagatggtccccagatgcggtcccgccctcagcagtttctagagaaccatcagatgtttccagggtgccccaaggacctgaaatgaccctgtgccttatttgaactaaccaatcagttcgcttctcgcttctgttcgcgcgcttctgctccccgagctcaataaaagagcccacaacccctcactcggcgcgccagtcctccgatagactgcgtcgcccgggtacccgtattcccaataaagcctcttgctgtttgcatccgaatcgtggactcgctgatccttgggagggtctcctcagattgattgactgcccacctcgggggtctttcatttggaggttccaccgagatttggagacccctgcccagggaccaccgacccccccgccgggaggtaagctggccagcggtcgtttcgtgtctgtctctgtctttgtgcgtgtttgtgccggcatctaatgtttgcgcctgcgtctgtactagttagctaactagctctgtatctggcggacccgtggtggaactgacgagttctgaacacccggccgcaaccctgggagacgtcccagggactttgggggccgtttttgtggcccgacctgaggaagggagtcgatgtggaatccgaccccgtcaggatatgtggttctggtaggagacgagaacctaaaacagttcccgcctccgtctgaatttttgctttcggtttggaaccgaagccgcgcgtcttgtctgctgcagcgctgcagcatcgttctgtgttgtctctgtctgactgtgtttctgtatttgtctgaaaattagggccagactgttaccactcccttaagtttgaccttaggtcactggaaagatgtcgagcggatcgctcacaaccagtcggtagatgtcaagaagagacgttgggttaccttctgctctgcagaatggccaacctttaacgtcggatggccgcgagacggcacctttaaccgagacctcatcacccaggttaagatcaaggtcttttcacctggcccgcatggacacccagaccaggtcccctacatcgtgacctgggaagccttggcttttgacccccctccctgggtcaagccctttgtacaccctaagcctccgcctcctcttcctccatccgccccgtctctcccccttgaacctcctcgttcgaccccgcctcgtatcctccctttatccagccctcactccttctctaggcgccggaattagatccccaccatggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccctatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgagttggaaggatgcctctggatggtcttaagtcgaggttaacgaattctaccgggtaggggaggcgcttttcccaaggcagtctggagcatgcgctttagcagccccgctgggcacttggcgctacacaagtggcctctggcctcgcacacattccacatccaccggtaggcgccaaccggctccgttctttggtggccccttcgcgccaccttctactcctcccctagtcaggaagttcccccccgccccgcagctcgcgtcgtgcaggacgtgacaaatggaagtagcacgtctcactagtctcgtgcagatggacagcaccgctgagcaatggaagcgggtaggcctttggggcagcggccaatagcagctttgctccttcgctttctgggctcagaggctgggaaggggtgggtccgggggcgggctcaggggcgggctcaggggcggggcgggcgcccgaaggtcctccggaggcccggcattctgcacgcttcaaaagcgcacgtctgccgcgctgttctcctcttcctcatctccgggcctttcgacctgcatcccgccaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagagtagatgccgaccgaacaagagctgatttcgagaacgcctcagccagcaactcgcgcgagcctagcaaggcaaatgcgagagaacggccttacgcttggtggcacagttctcgtccacagttcgctaagctcgctcggctgggtcgcgggagggccggtcgcagtgattcaggcccttctggattgtgttggtccccagggcacgattgtcatgcccacgcactcgggtgatctgactgatcccgcagattggagatcgccgcccgtgcctgccgattgggtgcagatccgtcgacctgcagccaagcttatcgataaaataaaagattttatttagtctccagaaaaaggggggaatgaaagaccccacctgtaggtttggcaagctagcttaagtaacgccattttgcaaggcatggaaaatacataactgagaatagagaagttcagatcaaggttaggaacagagagacagcagaatatgggccaaacaggatatctgtggtaagcagttcctgccccggctcagggccaagaacagatggtccccagatgcggtcccgccctcagcagtttctagagaaccatcagatgtttccagggtgccccaaggacctgaaatgaccctgtgccttatttgaactaaccaatcagttcgcttctcgcttctgttcgcgcgcttctgctccccgagctcaataaaagagcccacaacccctcactcggcgcgccagtcctccgatagactgcgtcgcccgggtacccgtgtatccaataaaccctcttgcagttgcatccgacttgtggtctcgctgttccttgggagggtctcctctgagtgattgactacccgtcagcgggggtctttcatgggtaacagtttcttgaagttggagaacaacattctgagggtaggagtcgaatattaagtaatcctgactcaattagccactgttttgaatccacatactccaatactcctgaaatagttcattatggacagcgcagaagagctggggagaattaattcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggcgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggcgattagtccaatttgttaaagacaggatatcagtggtccaggctctagttttgactcaacaatatcaccagctgaagcctatagagtacgagccatagataaaataaaagattttatttagtctccagaaaaagggggga

SEQ ID NO: 3851 - DNA, 7476 bp, Artificial Sequence
  Synthetic Polynucleotide
aatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgataagcttgggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgactctagaggatccccaccatgaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacctcgagaccgatttctacgactacaaggacgacgatgacaagtagtctagagggcccgcggttcgaaggtaagcctatccctaaccctctcctcggtctcgattctacgcgtaccggttagtaatgagtttggaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcagcacgtgttgacaattaatcatcggcatagtatatcggcatagtataatacgacaaggtgaggaactaaaccatggccaagcctttgtctcaagaagaatccaccctcattgaaagagcaacggctacaatcaacagcatccccatctctgaagactacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggctaagcacaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagctt

SEQ ID NO: 3852 - DNA, 226 bp, Artificial Sequence
  Synthetic Polynucleotide
ccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatgg

SEQ ID NO: 3853 - DNA, 418 bp, Artificial Sequence
  Synthetic Polynucleotide
aattaattctaaaatacagcatagcaaaactttaacctccaaatcaagcctctacttgaatccttttctgagggatgaataaggcataggcatcaggggctgttgccaatgtgcattagctgtttgcagcctcaccttctttcatggagtttaagatatagtgtattttcccaaggtttgaactagctcttcatttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagcttctagcttatcct

SEQ ID NO: 3854 - DNA, 5172 bp, Artificial Sequence
  Synthetic Polynucleotide
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 3855 - DNA, 2044 bp, Artificial Sequence
  Synthetic Polynucleotide
tttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttt

SEQ ID NO: 3856 - DNA, 1314 bp, Artificial Sequence
  Synthetic Polynucleotide
tttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttt

SEQ ID NO: 3857 - DNA, 5172 bp, Artificial Sequence; identical to SEQ ID NO: 3854
  Synthetic Polynucleotide

SEQ ID NO: 3858 - DNA, 4085 bp, Artificial Sequence
  Synthetic Polynucleotide encoding a targeting construct
ggatccagctggatgtctgcattgccgaggccaccagggctggctcagcaactgtcggggaatcaccagggtctgagaaatcttgtgcgcatgtgaggggctgtgggagcagagaaccactgggtgggaaattctaatccccaccctgctggaaactctctgggtggccccaacatgctaatcctccggcaaacctctgtttcctcctcaaaaggcaggaggtcggaaagaataaacaatgagagtcacattaaaaacacaaaatcctacggaaatactgaagaatgagtctcagcactaaggaaaagcctccagcagctcctgctttctgagggtgaaggatagacgctgtggctctgcatgactcactagcactctatcacggccatattctggcagggtcagtggctccaactaacatttgtttggtactttacagtttattaaatagatgtttatatggagaagctctcatttctttctcagaagagcctggctaggaaggtggatgaggcaccatattcattttgcaggtgaaattcctgagatgtaaggagctgctgtgacttgctcaaggccttatatcgagtaaacggtagcgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatgtgaagcagaccctgaatttcgacctgctgaagctggctggcgacgtggaatccaacccaggccctatggccttaccagtgaccgccttgctcctgccgctggccttgctgctccacgccgccaggccggacgtggtcatgacacagagcccttctagcctgtctgccagcgtgggcgacagagtgaccatcacctgtatggcctccgaggacatctacatccggctggcctggtatcagcagaagcctggaaacgcccctaagctgctgatctacgccgccacctctctggaaacaggcgtgccaagcagattttccggcagcggctctggcaccgatttcaccctgacaatatccagcctccagcctgaggacttcgccacctactactgccagcagtattggagcagcccctggacatttggcggaggcaccaaggtggaaatcaaaggcggaggcggaagtggaggcggaggatctggcggcggaggctctcaggttcagctgcaagagtctggccccggactggtcaagcctagccaaacactgagcctgacctgtaccgtgtccggctacagcatcaccagcgactacacctggaactggatcagacagcctcctggcaacggactggaatggatcggctacatcacctacagcggcagcaccagctacaaccccagcctgaaaagccgggtgctgatctccgtggacaccagcaagaatcaggtgtccctgaagctgagcagcgtgacagccgctgataccgccgtgtactactgtgccagactggggagaagatacacaatggactactggggccagggcaccaccgtgacagtttcttctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctgaccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggaattaattctaaaatacagcatagcaaaactttaacctccaaatcaagcctctacttgaatccttttctgagggatgaataaggcataggcatcaggggctgttgccaatgtgcattagctgtttgcagcctcaccttctttcatggagtttaagatatagtgtattttcccaaggtttgaactagctcttcatttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagcttctagcttatcctgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagccaccttcaggacaaaagtcagggaagggctctctgaagaaatgctacttgaagataccagccctaccaagggcagggagaggaccctatagaggcctgggaca

SEQ ID NO: 3859 - DNA, 4667 bp, Artificial Sequence
  Synthetic Polynucleotide encoding a targeting construct
ggatccagctggatgtctgcattgccgaggccaccagggctggctcagcaactgtcggggaatcaccagggtctgagaaatcttgtgcgcatgtgaggggctgtgggagcagagaaccactgggtgggaaattctaatccccaccctgctggaaactctctgggtggccccaacatgctaatcctccggcaaacctctgtttcctcctcaaaaggcaggaggtcggaaagaataaacaatgagagtcacattaaaaacacaaaatcctacggaaatactgaagaatgagtctcagcactaaggaaaagcctccagcagctcctgctttctgagggtgaaggatagacgctgtggctctgcatgactcactagcactctatcacggccatattctggcagggtcagtggctccaactaacatttgtttggtactttacagtttattaaatagatgtttatatggagaagctctcatttctttctcagaagagcctggctaggaaggtggatgaggcaccatattcattttgcaggtgaaattcctgagatgtaaggagctgctgtgacttgctcaaggccttatatcgagtaaacggtagcgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatgtgaagcagaccctgaatttcgacctgctgaagctggctggcgacgtggaatccaacccaggccctatggccttaccagtgaccgccttgctcctgccgctggccttgctgctccacgccgccaggccggacgtggtcatgacacagagcccttctagcctgtctgccagcgtgggcgacagagtgaccatcacctgtatggcctccgaggacatctacatccggctggcctggtatcagcagaagcctggaaacgcccctaagctgctgatctacgccgccacctctctggaaacaggcgtgccaagcagattttccggcagcggctctggcaccgatttcaccctgacaatatccagcctccagcctgaggacttcgccacctactactgccagcagtattggagcagcccctggacatttggcggaggcaccaaggtggaaatcaaaggcggaggcggaagtggaggcggaggatctggcggcggaggctctcaggttcagctgcaagagtctggccccggactggtcaagcctagccaaacactgagcctgacctgtaccgtgtccggctacagcatcaccagcgactacacctggaactggatcagacagcctcctggcaacggactggaatggatcggctacatcacctacagcggcagcaccagctacaaccccagcctgaaaagccgggtgctgatctccgtggacaccagcaagaatcaggtgtccctgaagctgagcagcgtgacagccgctgataccgccgtgtactactgtgccagactggggagaagatacacaatggactactggggccagggcaccaccgtgacagtttcttctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatcagggccaagcgatctggatctggagcaacaaacttctcactactcaaacaagcaggtgacgtggaggagaatcccgggccttctagtatggactggatttggcgcatccttttccttgtcggcgctgctaccggcgcgcattccttcgaaggcggactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctgaccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggaattaattctaaaatacagcatagcaaaactttaacctccaaatcaagcctctacttgaatccttttctgagggatgaataaggcataggcatcaggggctgttgccaatgtgcattagctgtttgcagcctcaccttctttcatggagtttaagatatagtgtattttcccaaggtttgaactagctcttcatttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagcttctagcttatcctgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagccaccttcaggacaaaagtcagggaagggctctctgaagaaatgctacttgaagataccagccctaccaagggcagggagaggaccctatagaggcctgggaca

SEQ ID NO: 3860 - DNA, 5716 bp, Artificial Sequence
  Synthetic Polynucleotide encoding a targeting construct
  misc_feature (3708)..(3708): n is a, c, g, or t
ggatccagctggatgtctgcattgccgaggccaccagggctggctcagcaactgtcggggaatcaccagggtctgagaaatcttgtgcgcatgtgaggggctgtgggagcagagaaccactgggtgggaaattctaatccccaccctgctggaaactctctgggtggccccaacatgctaatcctccggcaaacctctgtttcctcctcaaaaggcaggaggtcggaaagaataaacaatgagagtcacattaaaaacacaaaatcctacggaaatactgaagaatgagtctcagcactaaggaaaagcctccagcagctcctgctttctgagggtgaaggatagacgctgtggctctgcatgactcactagcactctatcacggccatattctggcagggtcagtggctccaactaacatttgtttggtactttacagtttattaaatagatgtttatatggagaagctctcatttctttctcagaagagcctggctaggaaggtggatgaggcaccatattcattttgcaggtgaaattcctgagatgtaaggagctgctgtgacttgctcaaggccttatatcgagtaaacggtagcgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatgtgaagcagaccctgaatttcgacctgctgaagctggctggcgacgtggaatccaacccaggccctatggccttaccagtgaccgccttgctcctgccgctggccttgctgctccacgccgccaggccggacgtggtcatgacacagagcccttctagcctgtctgccagcgtgggcgacagagtgaccatcacctgtatggcctccgaggacatctacatccggctggcctggtatcagcagaagcctggaaacgcccctaagctgctgatctacgccgccacctctctggaaacaggcgtgccaagcagattttccggcagcggctctggcaccgatttcaccctgacaatatccagcctccagcctgaggacttcgccacctactactgccagcagtattggagcagcccctggacatttggcggaggcaccaaggtggaaatcaaaggcggaggcggaagtggaggcggaggatctggcggcggaggctctcaggttcagctgcaagagtctggccccggactggtcaagcctagccaaacactgagcctgacctgtaccgtgtccggctacagcatcaccagcgactacacctggaactggatcagacagcctcctggcaacggactggaatggatcggctacatcacctacagcggcagcaccagctacaaccccagcctgaaaagccgggtgctgatctccgtggacaccagcaagaatcaggtgtccctgaagctgagcagcgtgacagccgctgataccgccgtgtactactgtgccagactggggagaagatacacaatggactactggggccagggcaccaccgtgacagtttcttctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatcagggccaagcgatctggatctggagcaacaaacttctcactactcaaacaagcaggtgacgtggaggagaatcccgggccttctagtatggactggatttggcgcatccttttccttgtcggcgctgctaccggcgcgcattccgatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagccaccttcaggacaaaagtcagggaagggctctctgaagaaatgctacttgaagataccagccctaccaagggcagggagaggaccctatagaggcctgggacantttttttttttttttttttttgagatggagttttgctcttgttgcccaggctggagtgcaatggtgcatcttggctcactacaacctctgcctcccaggttcaagtgattctcctgcctcagcctcccaagtagctgggattacaggcacccaccaccatgcccggctaattttttgtatttttagtagagacagggtttcactatgttggccaggctggtctcgaactcctgacctcaggtgatccacccgcttcagcctcccaaagtgctgggattacaggcgtgagccaccacacccggcctgcttttcttaaagatcaatctgagtgctgtacggagagtgggttgtaagccaagagtagaagcagaaagggagcagttgcagcagagagatgatggaggcctgggcagggtggtggcagggaggtaaccaacaccattcaggtttcaaaggtagaaccatgcagggatgagaaagcaaagaggggatcaaggaaggcagctggattttggcctgagcagctgagtcaatgatagtgccgtttactaagaagaaaccaaggaaaaaatttggggtgcagggatcaaaactttttggaacatatgaaagtacgtgtttatactctttatggcccttgtcactatgtatgcctcgctgcctccattggactctagaatgaagccaggcaagagcagggtctatgtgtgatggcacatgtggccagggtcatgcaacatgtactttgtacaaacagtgtatattgagtaaatagaaatggtgtccaggagccgaggtatcggtcctgccagggccaggggctctccctagcaggtgctcatatgctgtaagttccctccagatctctccacaaggaggcatggaaaggctgtagttgttcacctgcccaagaactaggaggtctggggtgggagagtcagcctgctctggatgctgaaagaatgtctgtttttccttttagaaagttcctgtgatgtcaagctggtcgagaaaagctttgaaacaggtaagacaggggtctagcctgggtttgcacaggattgcggaagtgatgaacccgcaataaccctgcctggatgagggagtgggaagaaattagtagatgtgggaatgaatgatgaggaatggaaacagcggttcaagacctgcccagagctgggtggggtctctcctgaatccctctcaccgtctctgactttccgttctaagcactttgaggatgagtttctagcttcaatagaccaaggactctctcctaggcctctgtattcctttcaacagctccactgtcaagagagccagagagagcttctgggtggcccagctgtgaaatttctgagtcccttagggatagccctaaacgaaccagatcatcctgaggacagccaagaggttttgccttctttcaagacaagcaacagtactcacataggctgtgggcaatggtcctgtctctcaagaatcccctgccactcctcacacccaccctgggcccatattcatttccatttgagttgttcttattgagtcatccttcctgtggcagcggaactcactaaggggcccatctggacccgaggtattgtgaagataaattctgagcacctaccccatccccagaagggctcagaaataaaataagagccaagtctagtcggtgtttcctgtcttgaaacacaatactgttggccctggaagaatgcacagaatctgtttgtaaggggatatgcacagaagctgcaagggacaggaggtgcaggagctgcaggcctcccccacccagcctgctctgccttggggaaaaccgtgggtgtgtcctgcaggccatgcaggcctgggacatgcaagcccataaccgctgtggcctcttggttttacagatacgaacctaaactttcaaaacctgtcagtgattgggttccgaatcctcctcctgaaagtggccgggtttaatctgctcatgacgctgcggctgtggtccagctga

SEQ ID NO: 3861 - DNA, 4610 bp, Artificial Sequence
  Synthetic Polynucleotide encoding a targeting construct
ggatccagctggatgtctgcattgccgaggccaccagggctggctcagcaactgtcggggaatcaccagggtctgagaaatcttgtgcgcatgtgaggggctgtgggagcagagaaccactgggtgggaaattctaatccccaccctgctggaaactctctgggtggccccaacatgctaatcctccggcaaacctctgtttcctcctcaaaaggcaggaggtcggaaagaataaacaatgagagtcacattaaaaacacaaaatcctacggaaatactgaagaatgagtctcagcactaaggaaaagcctccagcagctcctgctttctgagggtgaaggatagacgctgtggctctgcatgactcactagcactctatcacggccatattctggcagggtcagtggctccaactaacatttgtttggtactttacagtttattaaatagatgtttatatggagaagctctcatttctttctcagaagagcctggctaggaaggtggatgaggcaccatattcattttgcaggtgaaattcctgagatgtaaggagctgctgtgacttgctcaaggccttatatcgagtaaacggtagcgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatgtgaagcagaccctgaatttcgacctgctgaagctggctggcgacgtggaatccaacccaggccctatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctgaccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggaattaattctaaaatacagcatagcaaaactttaacctccaaatcaagcctctacttgaatccttttctgagggatgaataaggcataggcatcaggggctgttgccaatgtgcattagctgtttgcagcctcaccttctttcatggagtttaagatatagtgtattttcccaaggtttgaactagctcttcatttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagcttctagcttatcctgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagccaccttcaggacaaaagtcagggaagggctctctgaagaaatgctacttgaagataccagccctaccaagggcagggagaggaccctatagaggcctgggaca

SEQ ID NO: 3862 - DNA, 4676 bp, Artificial Sequence
  Synthetic Polynucleotide encoding a targeting construct
ggatccagctggatgtctgcattgccgaggccaccagggctggctcagcaactgtcggggaatcaccagggtctgagaaatcttgtgcgcatgtgaggggctgtgggagcagagaaccactgggtgggaaattctaatccccaccctgctggaaactctctgggtggccccaacatgctaatcctccggcaaacctctgtttcctcctcaaaaggcaggaggtcggaaagaataaacaatgagagtcacattaaaaacacaaaatcctacggaaatactgaagaatgagtctcagcactaaggaaaagcctccagcagctcctgctttctgagggtgaaggatagacgctgtggctctgcatgactcactagcactctatcacggccatattctggcagggtcagtggctccaactaacatttgtttggtactttacagtttattaaatagatgtttatatggagaagctctcatttctttctcagaagagcctggctaggaaggtggatgaggcaccatattcattttgcaggtgaaattcctgagatgtaaggagctgctgtgacttgctcaaggccttatatcgagtaaacggtagcgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatgtgaagcagaccctgaatttcgacctgctgaagctggctggcgacgtggaatccaacccaggccctatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctctgaccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggaattaattctaaaatacagcatagcaaaactttaacctccaaatcaagcctctacttgaatccttttctgagggatgaataaggcataggcatcaggggctgttgccaatgtgcattagctgtttgcagcctcaccttctttcatggagtttaagatatagtgtattttcccaaggtttgaactagctcttcatttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagcttctagcttatcctgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagccaccttcaggacaaaagtcagggaagggctctctgaagaaatgctacttgaagataccagccctaccaagggcagggagaggaccctatagaggcctgggaca

SEQ ID NO: 3863 - DNA, 6100 bp, Artificial Sequence
  Synthetic Polynucleotide encoding a targeting construct
  misc_feature (4092)..(4092): n is a, c, g, or t
ggatccagctggatgtctgcattgccgaggccaccagggctggctcagcaactgtcggggaatcaccagggtctgagaaatcttgtgcgcatgtgaggggctgtgggagcagagaaccactgggtgggaaattctaatccccaccctgctggaaactctctgggtggccccaacatgctaatcctccggcaaacctctgtttcctcctcaaaaggcaggaggtcggaaagaataaacaatgagagtcacattaaaaacacaaaatcctacggaaatactgaagaatgagtctcagcactaaggaaaagcctccagcagctcctgctttctgagggtgaaggatagacgctgtggctctgcatgactcactagcactctatcacggccatattctggcagggtcagtggctccaactaacatttgtttggtactttacagtttattaaatagatgtttatatggagaagctctcatttctttctcagaagagcctggctaggaaggtggatgaggcaccatattcattttgcaggtgaaattcctgagatgtaaggagctgctgtgacttgctcaaggccttatatcgagtaaacggtagcgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatgtgaagcagaccctgaatttcgacctgctgaagctggctggcgacgtggaatccaacccaggccctatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctgagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagccaccttcaggacaaaagtcagggaagggctctctgaagaaatgctacttgaagataccagccctaccaagggcagggagaggaccctatagaggcctgggacantttttttttttttttttttttgagatggagttttgctcttgttgcccaggctggagtgcaatggtgcatcttggctcactacaacctctgcctcccaggttcaagtgattctcctgcctcagcctcccaagtagctgggattacaggcacccaccaccatgcccggctaattttttgtatttttagtagagacagggtttcactatgttggccaggctggtctcgaactcctgacctcaggtgatccacccgcttcagcctcccaaagtgctgggattacaggcgtgagccaccacacccggcctgcttttcttaaagatcaatctgagtgctgtacggagagtgggttgtaagccaagagtagaagcagaaagggagcagttgcagcagagagatgatggaggcctgggcagggtggtggcagggaggtaaccaacaccattcaggtttcaaaggtagaaccatgcagggatgagaaagcaaagaggggatcaaggaaggcagctggattttggcctgagcagctgagtcaatgatagtgccgtttactaagaagaaaccaaggaaaaaatttggggtgcagggatcaaaactttttggaacatatgaaagtacgtgtttatactctttatggcccttgtcactatgtatgcctcgctgcctccattggactctagaatgaagccaggcaagagcagggtctatgtgtgatggcacatgtggccagggtcatgcaacatgtactttgtacaaacagtgtatattgagtaaatagaaatggtgtccaggagccgaggtatcggtcctgccagggccaggggctctccctagcaggtgctcatatgctgtaagttccctccagatctctccacaaggaggcatggaaaggctgtagttgttcacctgcccaagaactaggaggtctggggtgggagagtcagcctgctctggatgctgaaagaatgtctgtttttccttttagaaagttcctgtgatgtcaagctggtcgagaaaagctttgaaacaggtaagacaggggtctagcctgggtttgcacaggattgcggaagtgatgaacccgcaataaccctgcctggatgagggagtgggaagaaattagtagatgtgggaatgaatgatgaggaatggaaacagcggttcaagacctgcccagagctgggtggggtctctcctgaatccctctcaccgtctctgactttccgttctaagcactttgaggatgagtttctagcttcaatagaccaaggactctctcctaggcctctgtattcctttcaacagctccactgtcaagagagccagagagagcttctgggtggcccagctgtgaaatttctgagtcccttagggatagccctaaacgaaccagatcatcctgaggacagccaagaggttttgccttctttcaagacaagcaacagtactcacataggctgtgggcaatggtcctgtctctcaagaatcccctgccactcctcacacccaccctgggcccatattcatttccatttgagttgttcttattgagtcatccttcctgtggcagcggaactcactaaggggcccatctggacccgaggtattgtgaagataaattctgagcacctaccccatccccagaagggctcagaaataaaataagagccaagtctagtcggtgtttcctgtcttgaaacacaatactgttggccctggaagaatgcacagaatctgtttgtaaggggatatgcacagaagctgcaagggacaggaggtgcaggagctgcaggcctcccccacccagcctgctctgccttggggaaaaccgtgggtgtgtcctgcaggccatgcaggcctgggacatgcaagcccataaccgctgtggcctcttggttttacagatacgaacctaaactttcaaaacctgtcagtgattgggttccgaatcctcctcctgaaagtggccgggtttaatctgctcatgacgctgcggctgtggtccagctga

SEQ ID NO: 3864 - DNA, 5674 bp, Artificial Sequence
  Synthetic Polynucleotide encoding a targeting construct
  misc_feature (3666)..(3666): n is a, c, g, or t
ggatccagctggatgtctgcattgccgaggccaccagggctggctcagcaactgtcggggaatcaccagggtctgagaaatcttgtgcgcatgtgaggggctgtgggagcagagaaccactgggtgggaaattctaatccccaccctgctggaaactctctgggtggccccaacatgctaatcctccggcaaacctctgtttcctcctcaaaaggcaggaggtcggaaagaataaacaatgagagtcacattaaaaacacaaaatcctacggaaatactgaagaatgagtctcagcactaaggaaaagcctccagcagctcctgctttctgagggtgaaggatagacgctgtggctctgcatgactcactagcactctatcacggccatattctggcagggtcagtggctccaactaacatttgtttggtactttacagtttattaaatagatgtttatatggagaagctctcatttctttctcagaagagcctggctaggaaggtggatgaggcaccatattcattttgcaggtgaaattcctgagatgtaaggagctgctgtgacttgctcaaggccttatatcgagtaaacggtagcgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatgtgaagcagaccctgaatttcgacctgctgaagctggctggcgacgtggaatccaacccaggccctatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagccaccttcaggacaaaagtcagggaagggctctctgaagaaatgctacttgaagataccagccctaccaagggcagggagaggaccctatagaggcctgggacantttttttttttttttttttttgagatggagttttgctcttgttgcccaggctggagtgcaatggtgcatcttggctcactacaacctctgcctcccaggttcaagtgattctcctgcctcagcctcccaagtagctgggattacaggcacccaccaccatgcccggctaattttttgtatttttagtagagacagggtttcactatgttggccaggctggtctcgaactcctgacctcaggtgatccacccgcttcagcctcccaaagtgctgggattacaggcgtgagccaccacacccggcctgcttttcttaaagatcaatctgagtgctgtacggagagtgggttgtaagccaagagtagaagcagaaagggagcagttgcagcagagagatgatggaggcctgggcagggtggtggcagggaggtaaccaacaccattcaggtttcaaaggtagaaccatgcagggatgagaaagcaaagaggggatcaaggaaggcagctggattttggcctgagcagctgagtcaatgatagtgccgtttactaagaagaaaccaaggaaaaaatttggggtgcagggatcaaaactttttggaacatatgaaagtacgtgtttatactctttatggcccttgtcactatgtatgcctcgctgcctccattggactctagaatgaagccaggcaagagcagggtctatgtgtgatggcacatgtggccagggtcatgcaacatgtactttgtacaaacagtgtatattgagtaaatagaaatggtgtccaggagccgaggtatcggtcctgccagggccaggggctctccctagcaggtgctcatatgctgtaagttccctccagatctctccacaaggaggcatggaaaggctgtagttgttcacctgcccaagaactaggaggtctggggtgggagagtcagcctgctctggatgctgaaagaatgtctgtttttccttttagaaagttcctgtgatgtcaagctggtcgagaaaagctttgaaacaggtaagacaggggtctagcctgggtttgcacaggattgcggaagtgatgaacccgcaataaccctgcctggatgagggagtgggaagaaattagtagatgtgggaatgaatgatgaggaatggaaacagcggttcaagacctgcccagagctgggtggggtctctcctgaatccctctcaccgtctctgactttccgttctaagcactttgaggatgagtttctagcttcaatagaccaaggactctctcctaggcctctgtattcctttcaacagctccactgtcaagagagccagagagagcttctgggtggcccagctgtgaaatttctgagtcccttagggatagccctaaacgaaccagatcatcctgaggacagccaagaggttttgccttctttcaagacaagcaacagtactcacataggctgtgggcaatggtcctgtctctcaagaatcccctgccactcctcacacccaccctgggcccatattcatttccatttgagttgttcttattgagtcatccttcctgtggcagcggaactcactaaggggcccatctggacccgaggtattgtgaagataaattctgagcacctaccccatccccagaagggctcagaaataaaataagagccaagtctagtcggtgtttcctgtcttgaaacacaatactgttggccctggaagaatgcacagaatctgtttgtaaggggatatgcacagaagctgcaagggacaggaggtgcaggagctgcaggcctcccccacccagcctgctctgccttggggaaaaccgtgggtgtgtcctgcaggccatgcaggcctgggacatgcaagcccataaccgctgtggcctcttggttttacagatacgaacctaaactttcaaaacctgtcagtgattgggttccgaatcctcctcctgaaagtggccgggtttaatctgctcatgacgctgcggctgtggtccagctga

SEQ ID NO: 3865 - DNA, 4688 bp, Artificial Sequence
  Synthetic Polynucleotide encoding a targeting construct
ggatccagctggatgtctgcattgccgaggccaccagggctggctcagcaactgtcggggaatcaccagggtctgagaaatcttgtgcgcatgtgaggggctgtgggagcagagaaccactgggtgggaaattctaatccccaccctgctggaaactctctgggtggccccaacatgctaatcctccggcaaacctctgtttcctcctcaaaaggcaggaggtcggaaagaataaacaatgagagtcacattaaaaacacaaaatcctacggaaatactgaagaatgagtctcagcactaaggaaaagcctccagcagctcctgctttctgagggtgaaggatagacgctgtggctctgcatgactcactagcactctatcacggccatattctggcagggtcagtggctccaactaacatttgtttggtactttacagtttattaaatagatgtttatatggagaagctctcatttctttctcagaagagcctggctaggaaggtggatgaggcaccatattcattttgcaggtgaaattcctgagatgtaaggagctgctgtgacttgctcaaggccttatatcgagtaaacggtagcgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatgtgaagcagaccctgaatttcgacctgctgaagctggctggcgacgtggaatccaacccaggccctatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctgaccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggaattaattctaaaatacagcatagcaaaactttaacctccaaatcaagcctctacttgaatccttttctgagggatgaataaggcataggcatcaggggctgttgccaatgtgcattagctgtttgcagcctcaccttctttcatggagtttaagatatagtgtattttcccaaggtttgaactagctcttcatttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagcttctagcttatcctgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagccaccttcaggacaaaagtcagggaagggctctctgaagaaatgctacttgaagataccagccctaccaagggcagggagaggaccctatagaggcctgggaca

SEQ ID NO: 3866 - DNA, 4598 bp, Artificial Sequence
  Synthetic Polynucleotide encoding a targeting construct
ggatccagctggatgtctgcattgccgaggccaccagggctggctcagcaactgtcggggaatcaccagggtctgagaaatcttgtgcgcatgtgaggggctgtgggagcagagaaccactgggtgggaaattctaatccccaccctgctggaaactctctgggtggccccaacatgctaatcctccggcaaacctctgtttcctcctcaaaaggcaggaggtcggaaagaataaacaatgagagtcacattaaaaacacaaaatcctacggaaatactgaagaatgagtctcagcactaaggaaaagcctccagcagctcctgctttctgagggtgaaggatagacgctgtggctctgcatgactcactagcactctatcacggccatattctggcagggtcagtggctccaactaacatttgtttggtactttacagtttattaaatagatgtttatatggagaagctctcatttctttctcagaagagcctggctaggaaggtggatgaggcaccatattcattttgcaggtgaaattcctgagatgtaaggagctgctgtgacttgctcaaggccttatatcgagtaaacggtagcgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatgtgaagcagaccctgaatttcgacctgctgaagctggctggcgacgtggaatccaacccaggccctatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctgaccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggaattaattctaaaatacagcatagcaaaactttaacctccaaatcaagcctctacttgaatccttttctgagggatgaataaggcataggcatcaggggctgttgccaatgtgcattagctgtttgcagcctcaccttctttcatggagtttaagatatagtgtattttcccaaggtttgaactagctcttcatttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagcttctagcttatcctgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagccaccttcaggacaaaagtcagggaagggctctctgaagaaatgctacttgaagataccagccctaccaagggcagggagaggaccctatagaggcctgggaca

SEQ ID NO: 3867 - DNA, 5659 bp, Artificial Sequence
  Synthetic Polynucleotide encoding a targeting construct
  misc_feature (3651)..(3651): n is a, c, g, or t
ggatccagctggatgtctgcattgccgaggccaccagggctggctcagcaactgtcggggaatcaccagggtctgagaaatcttgtgcgcatgtgaggggctgtgggagcagagaaccactgggtgggaaattctaatccccaccctgctggaaactctctgggtggccccaacatgctaatcctccggcaaacctctgtttcctcctcaaaaggcaggaggtcggaaagaataaacaatgagagtcacattaaaaacacaaaatcctacggaaatactgaagaatgagtctcagcactaaggaaaagcctccagcagctcctgctttctgagggtgaaggatagacgctgtggctctgcatgactcactagcactctatcacggccatattctggcagggtcagtggctccaactaacatttgtttggtactttacagtttattaaatagatgtttatatggagaagctctcatttctttctcagaagagcctggctaggaaggtggatgaggcaccatattcattttgcaggtgaaattcctgagatgtaaggagctgctgtgacttgctcaaggccttatatcgagtaaacggtagcgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatgtgaagcagaccctgaatttcgacctgctgaagctggctggcgacgtggaatccaacccaggccctatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagccaccttcaggacaaaagtcagggaagggctctctgaagaaatgctacttgaagataccagccctaccaagggcagggagaggaccctatagaggcctgggacantttttttttttttttttttttgagatggagttttgctcttgttgcccaggctggagtgcaatggtgcatcttggctcactacaacctctgcctcccaggttcaagtgattctcctgcctcagcctcccaagtagctgggattacaggcacccaccaccatgcccggctaattttttgtatttttagtagagacagggtttcactatgttggccaggctggtctcgaactcctgacctcaggtgatccacccgcttcagcctcccaaagtgctgggattacaggcgtgagccaccacacccggcctgcttttcttaaagatcaatctgagtgctgtacggagagtgggttgtaagccaagagtagaagcagaaagggagcagttgcagcagagagatgatggaggcctgggcagggtggtggcagggaggtaaccaacaccattcaggtttcaaaggtagaaccatgcagggatgagaaagcaaagaggggatcaaggaaggcagctggattttggcctgagcagctgagtcaatgatagtgccgtttactaagaagaaaccaaggaaaaaatttggggtgcagggatcaaaactttttggaacatatgaaagtacgtgtttatactctttatggcccttgtcactatgtatgcctcgctgcctccattggactctagaatgaagccaggcaagagcagggtctatgtgtgatggcacatgtggccagggtcatgcaacatgtactttgtacaaacagtgtatattgagtaaatagaaatggtgtccaggagccgaggtatcggtcctgccagggccaggggctctccctagcaggtgctcatatgctgtaagttccctccagatctctccacaaggaggcatggaaaggctgtagttgttcacctgcccaagaactaggaggtctggggtgggagagtcagcctgctctggatgctgaaagaatgtctgtttttccttttagaaagttcctgtgatgtcaagctggtcgagaaaagctttgaaacaggtaagacaggggtctagcctgggtttgcacaggattgcggaagtgatgaacccgcaataaccctgcctggatgagggagtgggaagaaattagtagatgtgggaatgaatgatgaggaatggaaacagcggttcaagacctgcccagagctgggtggggtctctcctgaatccctctcaccgtctctgactttccgttctaagcactttgaggatgagtttctagcttcaatagaccaaggactctctcctaggcctctgtattcctttcaacagctccactgtcaagagagccagagagagcttctgggtggcccagctgtgaaatttctgagtcccttagggatagccctaaacgaaccagatcatcctgaggacagccaagaggttttgccttctttcaagacaagcaacagtactcacataggctgtgggcaatggtcctgtctctcaagaatcccctgccactcctcacacccaccctgggcccatattcatttccatttgagttgttcttattgagtcatccttcctgtggcagcggaactcactaaggggcccatctggacccgaggtattgtgaagataaattctgagcacctaccccatccccagaagggctcagaaataaaataagagccaagtctagtcggtgtttcctgtcttgaaacacaatactgttggccctggaagaatgcacagaatctgtttgtaaggggatatgcacagaagctgcaagggacaggaggtgcaggagctgcaggcctcccccacccagcctgctctgccttggggaaaaccgtgggtgtgtcctgcaggccatgcaggcctgggacatgcaagcccataaccgctgtggcctcttggttttacagatacgaacctaaactttcaaaacctgtcagtgattgggttccgaatcctcctcctgaaagtggccgggtttaatctgctcatgacgctgcggctgtggtccagctga

SEQ ID NO: 3868 - DNA, 6088 bp, Artificial Sequence
  Synthetic Polynucleotide encoding a targeting construct
  misc_feature (4080)..(4080): n is a, c, g, or t
ggatccagctggatgtctgcattgccgaggccaccagggctggctcagcaactgtcggggaatcaccagggtctgagaaatcttgtgcgcatgtgaggggctgtgggagcagagaaccactgggtgggaaattctaatccccaccctgctggaaactctctgggtggccccaacatgctaatcctccggcaaacctctgtttcctcctcaaaaggcaggaggtcggaaagaataaacaatgagagtcacattaaaaacacaaaatcctacggaaatactgaagaatgagtctcagcactaaggaaaagcctccagcagctcctgctttctgagggtgaaggatagacgctgtggctctgcatgactcactagcactctatcacggccatattctggcagggtcagtggctccaactaacatttgtttggtactttacagtttattaaatagatgtttatatggagaagctctcatttctttctcagaagagcctggctaggaaggtggatgaggcaccatattcattttgcaggtgaaattcctgagatgtaaggagctgctgtgacttgctcaaggccttatatcgagtaaacggtagcgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatgtgaagcagaccctgaatttcgacctgctgaagctggctggcgacgtggaatccaacccaggccctatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctgagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagccaccttcaggacaaaagtcagggaagggctctctgaagaaatgctacttgaagataccagccctaccaagggcagggagaggaccctatagaggcctgggacantttttttttttttttttttttgagatggagttttgctcttgttgcccaggctggagtgcaatggtgcatcttggctcactacaacctctgcctcccaggttcaagtgattctcctgcctcagcctcccaagtagctgggattacaggcacccaccaccatgcccggctaattttttgtatttttagtagagacagggtttcactatgttggccaggctggtctcgaactcctgacctcaggtgatccacccgcttcagcctcccaaagtgctgggattacaggcgtgagccaccacacccggcctgcttttcttaaagatcaatctgagtgctgtacggagagtgggttgtaagccaagagtagaagcagaaagggagcagttgcagcagagagatgatggaggcctgggcagggtggtggcagggaggtaaccaacaccattcaggtttcaaaggtagaaccatgcagggatgagaaagcaaagaggggatcaaggaaggcagctggattttggcctgagcagctgagtcaatgatagtgccgtttactaagaagaaaccaaggaaaaaatttggggtgcagggatcaaaactttttggaacatatgaaagtacgtgtttatactctttatggcccttgtcactatgtatgcctcgctgcctccattggactctagaatgaagccaggcaagagcagggtctatgtgtgatggcacatgtggccagggtcatgcaacatgtactttgtacaaacagtgtatattgagtaaatagaaatggtgtccaggagccgaggtatcggtcctgccagggccaggggctctccctagcaggtgctcatatgctgtaagttccctccagatctctccacaaggaggcatggaaaggctgtagttgttcacctgcccaagaactaggaggtctggggtgggagagtcagcctgctctggatgctgaaagaatgtctgtttttccttttagaaagttcctgtgatgtcaagctggtcgagaaaagctttgaaacaggtaagacaggggtctagcctgggtttgcacaggattgcggaagtgatgaacccgcaataaccctgcctggatgagggagtgggaagaaattagtagatgtgggaatgaatgatgaggaatggaaacagcggttcaagacctgcccagagctgggtggggtctctcctgaatccctctcaccgtctctgactttccgttctaagcactttgaggatgagtttctagcttcaatagaccaaggactctctcctaggcctctgtattcctttcaacagctccactgtcaagagagccagagagagcttctgggtggcccagctgtgaaatttctgagtcccttagggatagccctaaacgaaccagatcatcctgaggacagccaagaggttttgccttctttcaagacaagcaacagtactcacataggctgtgggcaatggtcctgtctctcaagaatcccctgccactcctcacacccaccctgggcccatattcatttccatttgagttgttcttattgagtcatccttcctgtggcagcggaactcactaaggggcccatctggacccgaggtattgtgaagataaattctgagcacctaccccatccccagaagggctcagaaataaaataagagccaagtctagtcggtgtttcctgtcttgaaacacaatactgttggccctggaagaatgcacagaatctgtttgtaaggggatatgcacagaagctgcaagggacaggaggtgcaggagctgcaggcctcccccacccagcctgctctgccttggggaaaaccgtgggtgtgtcctgcaggccatgcaggcctgggacatgcaagcccataaccgctgtggcctcttggttttacagatacgaacctaaactttcaaaacctgtcagtgattgggttccgaatcctcctcctgaaagtggccgggtttaatctgctcatgacgctgcggctgtggtccagctga

SEQ ID NO: 3869 - DNA, 3965 bp, Artificial Sequence
  Synthetic Polynucleotide encoding a targeting construct
ggatccagctggatgtctgcattgccgaggccaccagggctggctcagcaactgtcggggaatcaccagggtctgagaaatcttgtgcgcatgtgaggggctgtgggagcagagaaccactgggtgggaaattctaatccccaccctgctggaaactctctgggtggccccaacatgctaatcctccggcaaacctctgtttcctcctcaaaaggcaggaggtcggaaagaataaacaatgagagtcacattaaaaacacaaaatcctacggaaatactgaagaatgagtctcagcactaaggaaaagcctccagcagctcctgctttctgagggtgaaggatagacgctgtggctctgcatgactcactagcactctatcacggccatattctggcagggtcagtggctccaactaacatttgtttggtactttacagtttattaaatagatgtttatatggagaagctctcatttctttctcagaagagcctggctaggaaggtggatgaggcaccatattcattttgcaggtgaaattcctgagatgtaaggagctgctgtgacttgctcaaggccttatatcgagtaaacggtagcgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatgtgaagcagaccctgaatttcgacctgctgaagctggctggcgacgtggaatccaacccaggccctatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggtcaaggaacctcagtcaccgtctcctcaacgcgtgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctgaccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggaattaattctaaaatacagcatagcaaaactttaacctccaaatcaagcctctacttgaatccttttctgagggatgaataaggcataggcatcaggggctgttgccaatgtgcattagctgtttgcagcctcaccttctttcatggagtttaagatatagtgtattttcccaaggtttgaactagctcttcatttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagcttctagcttatcctgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagccaccttcaggacaaaagtcagggaagggctctctgaagaaatgctacttgaagataccagccctaccaagggcagggagaggaccctatagaggcctgggaca

SEQ ID NO: 3870 - DNA, 3956 bp, Artificial Sequence
  Synthetic Polynucleotide encoding a targeting construct
ggatccagctggatgtctgcattgccgaggccaccagggctggctcagcaactgtcggggaatcaccagggtctgagaaatcttgtgcgcatgtgaggggctgtgggagcagagaaccactgggtgggaaattctaatccccaccctgctggaaactctctgggtggccccaacatgctaatcctccggcaaacctctgtttcctcctcaaaaggcaggaggtcggaaagaataaacaatgagagtcacattaaaaacacaaaatcctacggaaatactgaagaatgagtctcagcactaaggaaaagcctccagcagctcctgctttctgagggtgaaggatagacgctgtggctctgcatgactcactagcactctatcacggccatattctggcagggtcagtggctccaactaacatttgtttggtactttacagtttattaaatagatgtttatatggagaagctctcatttctttctcagaagagcctggctaggaaggtggatgaggcaccatattcattttgcaggtgaaattcctgagatgtaaggagctgctgtgacttgctcaaggccttatatcgagtaaacggtagcgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatgtgaagcagaccctgaatttcgacctgctgaagctggctggcgacgtggaatccaacccaggccctatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggtcaaggaacctcagtcaccgtctcctcaacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctgaccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggaattaattctaaaatacagcatagcaaaactttaacctccaaatcaagcctctacttgaatccttttctgagggatgaataaggcataggcatcaggggctgttgccaatgtgcattagctgtttgcagcctcaccttctttcatggagtttaagatatagtgtattttcccaaggtttgaactagctcttcatttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagcttctagcttatcctgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagccaccttcaggacaaaagtcagggaagggctctctgaagaaatgctacttgaagataccagccctaccaagggcagggagaggaccctatagaggcctgggaca

SEQ ID NO: 3871 - DNA, 5455 bp, Artificial Sequence
  Synthetic Polynucleotide encoding a targeting construct
  misc_feature (3447)..(3447): n is a, c, g, or t
ggatccagctggatgtctgcattgccgaggccaccagggctggctcagcaactgtcggggaatcaccagggtctgagaaatcttgtgcgcatgtgaggggctgtgggagcagagaaccactgggtgggaaattctaatccccaccctgctggaaactctctgggtggccccaacatgctaatcctccggcaaacctctgtttcctcctcaaaaggcaggaggtcggaaagaataaacaatgagagtcacattaaaaacacaaaatcctacggaaatactgaagaatgagtctcagcactaaggaaaagcctccagcagctcctgctttctgagggtgaaggatagacgctgtggctctgcatgactcactagcactctatcacggccatattctggcagggtcagtggctccaactaacatttgtttggtactttacagtttattaaatagatgtttatatggagaagctctcatttctttctcagaagagcctggctaggaaggtggatgaggcaccatattcattttgcaggtgaaattcctgagatgtaaggagctgctgtgacttgctcaaggccttatatcgagtaaacggtagcgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatgtgaagcagaccctgaatttcgacctgctgaagctggctggcgacgtggaatccaacccaggccctatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggtcaaggaacctcagtcaccgtctcctcaacgcgtgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctgagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagccaccttcaggacaaaagtcagggaagggctctctgaagaaatgctacttgaagataccagccctaccaagggcagggagaggaccctatagaggcctgggacantttttttttttttttttttttgagatggagttttgctcttgttgcccaggctggagtgcaatggtgcatcttggctcactacaacctctgcctcccaggttcaagtgattctcctgcctcagcctcccaagtagctgggattacaggcacccaccaccatgcccggctaattttttgtatttttagtagagacagggtttcactatgttggccaggctggtctcgaactcctgacctcaggtgatccacccgcttcagcctcccaaagtgctgggattacaggcgtgagccaccacacccggcctgcttttcttaaagatcaatctgagtgctgtacggagagtgggttgtaagccaagagtagaagcagaaagggagcagttgcagcagagagatgatggaggcctgggcagggtggtggcagggaggtaaccaacaccattcaggtttcaaaggtagaaccatgcagggatgagaaagcaaagaggggatcaaggaaggcagctggattttggcctgagcagctgagtcaatgatagtgccgtttactaagaagaaaccaaggaaaaaatttggggtgcagggatcaaaactttttggaacatatgaaagtacgtgtttatactctttatggcccttgtcactatgtatgcctcgctgcctccattggactctagaatgaagccaggcaagagcagggtctatgtgtgatggcacatgtggccagggtcatgcaacatgtactttgtacaaacagtgtatattgagtaaatagaaatggtgtccaggagccgaggtatcggtcctgccagggccaggggctctccctagcaggtgctcatatgctgtaagttccctccagatctctccacaaggaggcatggaaaggctgtagttgttcacctgcccaagaactaggaggtctggggtgggagagtcagcctgctctggatgctgaaagaatgtctgtttttccttttagaaagttcctgtgatgtcaagctggtcgagaaaagctttgaaacaggtaagacaggggtctagcctgggtttgcacaggattgcggaagtgatgaacccgcaataaccctgcctggatgagggagtgggaagaaattagtagatgtgggaatgaatgatgaggaatggaaacagcggttcaagacctgcccagagctgggtggggtctctcctgaatccctctcaccgtctctgactttccgttctaagcactttgaggatgagtttctagcttcaatagaccaaggactctctcctaggcctctgtattcctttcaacagctccactgtcaagagagccagagagagcttctgggtggcccagctgtgaaatttctgagtcccttagggatagccctaaacgaaccagatcatcctgaggacagccaagaggttttgccttctttcaagacaagcaacagtactcacataggctgtgggcaatggtcctgtctctcaagaatcccctgccactcctcacacccaccctgggcccatattcatttccatttgagttgttcttattgagtcatccttcctgtggcagcggaactcactaaggggcccatctggacccgaggtattgtgaagataaattctgagcacctaccccatccccagaagggctcagaaataaaataagagccaagtctagtcggtgtttcctgtcttgaaacacaatactgttggccctggaagaatgcacagaatctgtttgtaaggggatatgcacagaagctgcaagggacaggaggtgcaggagctgcaggcctcccccacccagcctgctctgccttggggaaaaccgtgggtgtgtcctgcaggccatgcaggcctgggacatgcaagcccataaccgctgtggcctcttggttttacagatacgaacctaaactttcaaaacctgtcagtgattgggttccgaatcctcctcctgaaagtggccgggtttaatctgctcatgacgctgcggctgtggtccagctga

SEQ ID NO: 3872 - DNA, 5017 bp, Artificial Sequence
  Synthetic Polynucleotide encoding a targeting construct
  misc_feature (3009)..(3009): n is a, c, g, or t
ggatccagctggatgtctgcattgccgaggccaccagggctggctcagcaactgtcggggaatcaccagggtctgagaaatcttgtgcgcatgtgaggggctgtgggagcagagaaccactgggtgggaaattctaatccccaccctgctggaaactctctgggtggccccaacatgctaatcctccggcaaacctctgtttcctcctcaaaaggcaggaggtcggaaagaataaacaatgagagtcacattaaaaacacaaaatcctacggaaatactgaagaatgagtctcagcactaaggaaaagcctccagcagctcctgctttctgagggtgaaggatagacgctgtggctctgcatgactcactagcactctatcacggccatattctggcagggtcagtggctccaactaacatttgtttggtactttacagtttattaaatagatgtttatatggagaagctctcatttctttctcagaagagcctggctaggaaggtggatgaggcaccatattcattttgcaggtgaaattcctgagatgtaaggagctgctgtgacttgctcaaggccttatatcgagtaaacggtagcgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatgtgaagcagaccctgaatttcgacctgctgaagctggctggcgacgtggaatccaacccaggccctatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggtcaaggaacctcagtcaccgtctcctcagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagccaccttcaggacaaaagtcagggaagggctctctgaagaaatgctacttgaagataccagccctaccaagggcagggagaggaccctatagaggcctgggacantttttttttttttttttttttgagatggagttttgctcttgttgcccaggctggagtgcaatggtgcatcttggctcactacaacctctgcctcccaggttcaagtgattctcctgcctcagcctcccaagtagctgggattacaggcacccaccaccatgcccggctaattttttgtatttttagtagagacagggtttcactatgttggccaggctggtctcgaactcctgacctcaggtgatccacccgcttcagcctcccaaagtgctgggattacaggcgtgagccaccacacccggcctgcttttcttaaagatcaatctgagtgctgtacggagagtgggttgtaagccaagagtagaagcagaaagggagcagttgcagcagagagatgatggaggcctgggcagggtggtggcagggaggtaaccaacaccattcaggtttcaaaggtagaaccatgcagggatgagaaagcaaagaggggatcaaggaaggcagctggattttggcctgagcagctgagtcaatgatagtgccgtttactaagaagaaaccaaggaaaaaatttggggtgcagggatcaaaactttttggaacatatgaaagtacgtgtttatactctttatggcccttgtcactatgtatgcctcgctgcctccattggactctagaatgaagccaggcaagagcagggtctatgtgtgatggcacatgtggccagggtcatgcaacatgtactttgtacaaacagtgtatattgagtaaatagaaatggtgtccaggagccgaggtatcggtcctgccagggccaggggctctccctagcaggtgctcatatgctgtaagttccctccagatctctccacaaggaggcatggaaaggctgtagttgttcacctgcccaagaactaggaggtctggggtgggagagtcagcctgctctggatgctgaaagaatgtctgtttttccttttagaaagttcctgtgatgtcaagctggtcgagaaaagctttgaaacaggtaagacaggggtctagcctgggtttgcacaggattgcggaagtgatgaacccgcaataaccctgcctggatgagggagtgggaagaaattagtagatgtgggaatgaatgatgaggaatggaaacagcggttcaagacctgcccagagctgggtggggtctctcctgaatccctctcaccgtctctgactttccgttctaagcactttgaggatgagtttctagcttcaatagaccaaggactctctcctaggcctctgtattcctttcaacagctccactgtcaagagagccagagagagcttctgggtggcccagctgtgaaatttctgagtcccttagggatagccctaaacgaaccagatcatcctgaggacagccaagaggttttgccttctttcaagacaagcaacagtactcacataggctgtgggcaatggtcctgtctctcaagaatcccctgccactcctcacacccaccctgggcccatattcatttccatttgagttgttcttattgagtcatccttcctgtggcagcggaactcactaaggggcccatctggacccgaggtattgtgaagataaattctgagcacctaccccatccccagaagggctcagaaataaaataagagccaagtctagtcggtgtttcctgtcttgaaacacaatactgttggccctggaagaatgcacagaatctgtttgtaaggggatatgcacagaagctgcaagggacaggaggtgcaggagctgcaggcctcccccacccagcctgctctgccttggggaaaaccgtgggtgtgtcctgcaggccatgcaggcctgggacatgcaagcccataaccgctgtggcctcttggttttacagatacgaacctaaactttcaaaacctgtcagtgattgggttccgaatcctcctcctgaaagtggccgggtttaatctgctcatgacgctgcggctgtggtccagctga

SEQ ID NO: 3873 - DNA, 4688 bp, Artificial Sequence
  Synthetic Polynucleotide encoding a targeting construct
ggatccagctggatgtctgcattgccgaggccaccagggctggctcagcaactgtcggggaatcaccagggtctgagaaatcttgtgcgcatgtgaggggctgtgggagcagagaaccactgggtgggaaattctaatccccaccctgctggaaactctctgggtggccccaacatgctaatcctccggcaaacctctgtttcctcctcaaaaggcaggaggtcggaaagaataaacaatgagagtcacattaaaaacacaaaatcctacggaaatactgaagaatgagtctcagcactaaggaaaagcctccagcagctcctgctttctgagggtgaaggatagacgctgtggctctgcatgactcactagcactctatcacggccatattctggcagggtcagtggctccaactaacatttgtttggtactttacagtttattaaatagatgtttatatggagaagctctcatttctttctcagaagagcctggctaggaaggtggatgaggcaccatattcattttgcaggtgaaattcctgagatgtaaggagctgctgtgacttgctcaaggccttatatcgagtaaacggtagcgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatgtgaagcagaccctgaatttcgacctgctgaagctggctggcgacgtggaatccaacccaggccctatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggaaaccaattcccaaccctcttctgggactggattcaaccggcagcggcgaggacctgaaaaacgtgttcccacccgaggtcgctgtgtttgagccatcagaagcagagatctcccacacccaaaaggccacactggtatgcctggccacaggcttctaccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggcagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctgtggtccagctgaccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggaattaattctaaaatacagcatagcaaaactttaacctccaaatcaagcctctacttgaatccttttctgagggatgaataaggcataggcatcaggggctgttgccaatgtgcattagctgtttgcagcctcaccttctttcatggagtttaagatatagtgtattttcccaaggtttgaactagctcttcatttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagcttctagcttatcctgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagccaccttcaggacaaaagtcagggaagggctctctgaagaaatgctacttgaagataccagccctaccaagggcagggagaggaccctatagaggcctgggaca

SEQ ID NO: 3874 - DNA, 4694 bp, Artificial Sequence
  Synthetic Polynucleotide encoding a targeting construct
ggatccagctggatgtctgcattgccgaggccaccagggctggctcagcaactgtcggggaatcaccagggtctgagaaatcttgtgcgcatgtgaggggctgtgggagcagagaaccactgggtgggaaattctaatccccaccctgctggaaactctctgggtggccccaacatgctaatcctccggcaaacctctgtttcctcctcaaaaggcaggaggtcggaaagaataaacaatgagagtcacattaaaaacacaaaatcctacggaaatactgaagaatgagtctcagcactaaggaaaagcctccagcagctcctgctttctgagggtgaaggatagacgctgtggctctgcatgactcactagcactctatcacggccatattctggcagggtcagtggctccaactaacatttgtttggtactttacagtttattaaatagatgtttatatggagaagctctcatttctttctcagaagagcctggctaggaaggtggatgaggcaccatattcattttgcaggtgaaattcctgagatgtaaggagctgctgtgacttgctcaaggccttatatcgagtaaacggtagcgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatgtgaagcagaccctgaatttcgacctgctgaagctggctggcgacgtggaatccaacccaggccctatggccttaccagtgaccgccttgctcctgccgctggccttgctgctccacgccgccaggccgcagtctgtggtcacacagcctccatccgtgtctgctgcccctggacagaaagtgaccatcagctgtagcggcagcagcagcaacatcggcaacaactacgtgtcctggtatcagcagctgcccggcacagctcccaaactgctgatctacgacaacaacaagcggcccagcggcatccccgatagattttctgccagcaagagcggcaccagcgccacactgggaatcacaggactccagaccagagatgaggccgactactactgcggcacctgggattcttctctgtccgcctgggttttcggcggaggcacaaaactgacagtgctcggactcgaggggaaaccaattcccaaccctcttctgggactggattcaaccggcagcggcgaggacctgaaaaacgtgttcccacccgaggtcgctgtgtttgagccatcagaagcagagatctcccacacccaaaaggccacactggtatgcctggccacaggcttctaccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggcagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctggttcagtctggggccgaagtgaagaaacctggcagcagcgtgaaggtgtcctgcaaggcttccggcgataccttcagcagctactacatcagctgggtccgacaggccccaggacaaggacttgagtggatgggcagaatcatccccatcctgggaatcgccaactacgcccagaaataccagggcagagtgaccctgagcgccgacaagagcacaagcaccagctacatggaactgaacagcctgagcagcgaggacaccgccgtgtactattgtgccctggactggtcctacagcatcgactattggggccagggcaccctggtcacagtctcttctacgcgtgagcagaaactgatctcggaagaggatgggagcggcatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctgtggtccagctgaccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggaattaattctaaaatacagcatagcaaaactttaacctccaaatcaagcctctacttgaatccttttctgagggatgaataaggcataggcatcaggggctgttgccaatgtgcattagctgtttgcagcctcaccttctttcatggagtttaagatatagtgtattttcccaaggtttgaactagctcttcatttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagcttctagcttatcctgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagccaccttcaggacaaaagtcagggaagggctctctgaagaaatgctacttgaagataccagccctaccaagggcagggagaggaccctatagaggcctgggaca

SEQ ID NO: 3875 - DNA, 5761 bp, Artificial Sequence
  Synthetic Polynucleotide encoding a targeting construct
  misc_feature (3753)..(3753): n is a, c, g, or t
ggatccagctggatgtctgcattgccgaggccaccagggctggctcagcaactgtcggggaatcaccagggtctgagaaatcttgtgcgcatgtgaggggctgtgggagcagagaaccactgggtgggaaattctaatccccaccctgctggaaactctctgggtggccccaacatgctaatcctccggcaaacctctgtttcctcctcaaaaggcaggaggtcggaaagaataaacaatgagagtcacattaaaaacacaaaatcctacggaaatactgaagaatgagtctcagcactaaggaaaagcctccagcagctcctgctttctgagggtgaaggatagacgctgtggctctgcatgactcactagcactctatcacggccatattctggcagggtcagtggctccaactaacatttgtttggtactttacagtttattaaatagatgtttatatggagaagctctcatttctttctcagaagagcctggctaggaaggtggatgaggcaccatattcattttgcaggtgaaattcctgagatgtaaggagctgctgtgacttgctcaaggccttatatcgagtaaacggtagcgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatgtgaagcagaccctgaatttcgacctgctgaagctggctggcgacgtggaatccaacccaggccctatggccttaccagtgaccgccttgctcctgccgctggccttgctgctccacgccgccaggccgcagtctgtggtcacacagcctccatccgtgtctgctgcccctggacagaaagtgaccatcagctgtagcggcagcagcagcaacatcggcaacaactacgtgtcctggtatcagcagctgcccggcacagctcccaaactgctgatctacgacaacaacaagcggcccagcggcatccccgatagattttctgccagcaagagcggcaccagcgccacactgggaatcacaggactccagaccagagatgaggccgactactactgcggcacctgggattcttctctgtccgcctgggttttcggcggaggcacaaaactgacagtgctcggactcgaggggaaaccaattcccaaccctcttctgggactggattcaaccggcagcggcgaggacctgaaaaacgtgttcccacccgaggtcgctgtgtttgagccatcagaagcagagatctcccacacccaaaaggccacactggtatgcctggccacaggcttctaccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggcagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctggttcagtctggggccgaagtgaagaaacctggcagcagcgtgaaggtgtcctgcaaggcttccggcgataccttcagcagctactacatcagctgggtccgacaggccccaggacaaggacttgagtggatgggcagaatcatccccatcctgggaatcgccaactacgcccagaaataccagggcagagtgaccctgagcgccgacaagagcacaagcaccagctacatggaactgaacagcctgagcagcgaggacaccgccgtgtactattgtgccctggactggtcctacagcatcgactattggggccagggcaccctggtcacagtctcttctacgcgtgagcagaaactgatctcggaagaggatgggagcggcgatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagccaccttcaggacaaaagtcagggaagggctctctgaagaaatgctacttgaagataccagccctaccaagggcagggagaggaccctatagaggcctgggacantttttttttttttttttttttgagatggagttttgctcttgttgcccaggctggagtgcaatggtgcatcttggctcactacaacctctgcctcccaggttcaagtgattctcctgcctcagcctcccaagtagctgggattacaggcacccaccaccatgcccggctaattttttgtatttttagtagagacagggtttcactatgttggccaggctggtctcgaactcctgacctcaggtgatccacccgcttcagcctcccaaagtgctgggattacaggcgtgagccaccacacccggcctgcttttcttaaagatcaatctgagtgctgtacggagagtgggttgtaagccaagagtagaagcagaaagggagcagttgcagcagagagatgatggaggcctgggcagggtggtggcagggaggtaaccaacaccattcaggtttcaaaggtagaaccatgcagggatgagaaagcaaagaggggatcaaggaaggcagctggattttggcctgagcagctgagtcaatgatagtgccgtttactaagaagaaaccaaggaaaaaatttggggtgcagggatcaaaactttttggaacatatgaaagtacgtgtttatactctttatggcccttgtcactatgtatgcctcgctgcctccattggactctagaatgaagccaggcaagagcagggtctatgtgtgatggcacatgtggccagggtcatgcaacatgtactttgtacaaacagtgtatattgagtaaatagaaatggtgtccaggagccgaggtatcggtcctgccagggccaggggctctccctagcaggtgctcatatgctgtaagttccctccagatctctccacaaggaggcatggaaaggctgtagttgttcacctgcccaagaactaggaggtctggggtgggagagtcagcctgctctggatgctgaaagaatgtctgtttttccttttagaaagttcctgtgatgtcaagctggtcgagaaaagctttgaaacaggtaagacaggggtctagcctgggtttgcacaggattgcggaagtgatgaacccgcaataaccctgcctggatgagggagtgggaagaaattagtagatgtgggaatgaatgatgaggaatggaaacagcggttcaagacctgcccagagctgggtggggtctctcctgaatccctctcaccgtctctgactttccgttctaagcactttgaggatgagtttctagcttcaatagaccaaggactctctcctaggcctctgtattcctttcaacagctccactgtcaagagagccagagagagcttctgggtggcccagctgtgaaatttctgagtcccttagggatagccctaaacgaaccagatcatcctgaggacagccaagaggttttgccttctttcaagacaagcaacagtactcacataggctgtgggcaatggtcctgtctctcaagaatcccctgccactcctcacacccaccctgggcccatattcatttccatttgagttgttcttattgagtcatccttcctgtggcagcggaactcactaaggggcccatctggacccgaggtattgtgaagataaattctgagcacctaccccatccccagaagggctcagaaataaaataagagccaagtctagtcggtgtttcctgtcttgaaacacaatactgttggccctggaagaatgcacagaatctgtttgtaaggggatatgcacagaagctgcaagggacaggaggtgcaggagctgcaggcctcccccacccagcctgctctgccttggggaaaaccgtgggtgtgtcctgcaggccatgcaggcctgggacatgcaagcccataaccgctgtggcctcttggttttacagatacgaacctaaactttcaaaacctgtcagtgattgggttccgaatcctcctcctgaaagtggccgggtttaatctgctcatgacgctgcggctgtggtccagctga

SEQ ID NO: 3876 - DNA, 4592 bp, Artificial Sequence
  Synthetic Polynucleotide encoding a targeting construct
ggatccagctggatgtctgcattgccgaggccaccagggctggctcagcaactgtcggggaatcaccagggtctgagaaatcttgtgcgcatgtgaggggctgtgggagcagagaaccactgggtgggaaattctaatccccaccctgctggaaactctctgggtggccccaacatgctaatcctccggcaaacctctgtttcctcctcaaaaggcaggaggtcggaaagaataaacaatgagagtcacattaaaaacacaaaatcctacggaaatactgaagaatgagtctcagcactaaggaaaagcctccagcagctcctgctttctgagggtgaaggatagacgctgtggctctgcatgactcactagcactctatcacggccatattctggcagggtcagtggctccaactaacatttgtttggtactttacagtttattaaatagatgtttatatggagaagctctcatttctttctcagaagagcctggctaggaaggtggatgaggcaccatattcattttgcaggtgaaattcctgagatgtaaggagctgctgtgacttgctcaaggccttatatcgagtaaacggtagcgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatgtgaagcagaccctgaatttcgacctgctgaagctggctggcgacgtggaatccaacccaggccctatggccttaccagtgaccgccttgctcctgccgctggccttgctgctccacgccgccaggccgaatgctggcgtgacccagacacctaagttccaggtgctgaaaaccggccagagcatgaccctgcaatgcgcccaggacatgaaccatgagtacatgagctggtacagacaggaccccggcatgggcctgagactgatccactactctgtggctatccagaccaccgaccagggcgaagtgcccaatggctacaacgtgtccagaagcaccatcgaggacttcccactgagactgctgtctgccgctcctagccagaccagcgtgtacttttgtgccagcagctacctgggcaacaccggcgagctgttttttggcgagggcagcagactgaccgtggaggacctgaaaaacgtgttcccacccgaggtcgctgtgtttgagccatcagaagcagagatctcccacacccaaaaggccacactggtatgcctggccacaggcttctaccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggcagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagaagtgacacagatccctgccgctctgtctgtgcctgagggcgaaaacctggtgctgaactgctccttcaccgacagcgccatctacaacctccagtggttcaggcaggaccctggaaagggactgacaagcctgctgctgatccagagcagccagagagagcagacctccggcagactgaatgccagcctggataagagcagcggcaggtctaccctgtatatcgccgcttctcagcctggcgatagcgccacatatctgtgtgctgtgcggcctacaagcggcggcagctacatccctacatttggcagaggcaccagcctgatcgtgcacccttatgatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctgtggtccagctgaccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggaattaattctaaaatacagcatagcaaaactttaacctccaaatcaagcctctacttgaatccttttctgagggatgaataaggcataggcatcaggggctgttgccaatgtgcattagctgtttgcagcctcaccttctttcatggagtttaagatatagtgtattttcccaaggtttgaactagctcttcatttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagcttctagcttatcctgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagccaccttcaggacaaaagtcagggaagggctctctgaagaaatgctacttgaagataccagccctaccaagggcagggagaggaccctatagaggcctgggaca

SEQ ID NO: 3877 - DNA, 5656 bp, Artificial Sequence
  Synthetic Polynucleotide encoding a targeting construct
  misc_feature (3648)..(3648): n is a, c, g, or t
ggatccagctggatgtctgcattgccgaggccaccagggctggctcagcaactgtcggggaatcaccagggtctgagaaatcttgtgcgcatgtgaggggctgtgggagcagagaaccactgggtgggaaattctaatccccaccctgctggaaactctctgggtggccccaacatgctaatcctccggcaaacctctgtttcctcctcaaaaggcaggaggtcggaaagaataaacaatgagagtcacattaaaaacacaaaatcctacggaaatactgaagaatgagtctcagcactaaggaaaagcctccagcagctcctgctttctgagggtgaaggatagacgctgtggctctgcatgactcactagcactctatcacggccatattctggcagggtcagtggctccaactaacatttgtttggtactttacagtttattaaatagatgtttatatggagaagctctcatttctttctcagaagagcctggctaggaaggtggatgaggcaccatattcattttgcaggtgaaattcctgagatgtaaggagctgctgtgacttgctcaaggccttatatcgagtaaacggtagcgctggggcttagacgcaggtgttctgatttatagttcaaaacctctatcaatgagagagcaatctcctggtaatgtgatagatttcccaacttaatgccaacataccataaacctcccattctgctaatgcccagcctaagttggggagaccactccagattccaagatgtacagtttgctttgctgggcctttttcccatgcctgcctttactctgccagagttatattgctggggttttgaagaagatcctattaaataaaagaataagcagtattattaagtagccctgcatttcaggtttccttgagtggcaggccaggcctggccgtgaacgttcactgaaatcatggcctcttggccaagattgatagcttgtgcctgtccctgagtcccagtccatcacgagcagctggtttctaagatgctatttcccgtataaagcatgagaccgtgacttgccagccccacagagccccgcccttgtccatcactggcatctggactccagcctgggttggggcaaagagggaaatgagatcatgtcctaaccctgatcctcttgtcccacagatgtgaagcagaccctgaatttcgacctgctgaagctggctggcgacgtggaatccaacccaggccctatggccttaccagtgaccgccttgctcctgccgctggccttgctgctccacgccgccaggccgaatgctggcgtgacccagacacctaagttccaggtgctgaaaaccggccagagcatgaccctgcaatgcgcccaggacatgaaccatgagtacatgagctggtacagacaggaccccggcatgggcctgagactgatccactactctgtggctatccagaccaccgaccagggcgaagtgcccaatggctacaacgtgtccagaagcaccatcgaggacttcccactgagactgctgtctgccgctcctagccagaccagcgtgtacttttgtgccagcagctacctgggcaacaccggcgagctgttttttggcgagggcagcagactgaccgtggaggacctgaaaaacgtgttcccacccgaggtcgctgtgtttgagccatcagaagcagagatctcccacacccaaaaggccacactggtatgcctggccacaggcttctaccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggcagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagaagtgacacagatccctgccgctctgtctgtgcctgagggcgaaaacctggtgctgaactgctccttcaccgacagcgccatctacaacctccagtggttcaggcaggaccctggaaagggactgacaagcctgctgctgatccagagcagccagagagagcagacctccggcagactgaatgccagcctggataagagcagcggcaggtctaccctgtatatcgccgcttctcagcctggcgatagcgccacatatctgtgtgctgtgcggcctacaagcggcggcagctacatccctacatttggcagaggcaccagcctgatcgtgcacccttatgatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccaggtaagggcagctttggtgccttcgcaggctgtttccttgcttcaggaatggccaggttctgcccagagctctggtcaatgatgtctaaaactcctctgattggtggtctcggccttatccattgccaccaaaaccctctttttactaagaaacagtgagccttgttctggcagtccagagaatgacacgggaaaaaagcagatgaagagaaggtggcaggagagggcacgtggcccagcctcagtctctccaactgagttcctgcctgcctgcctttgctcagactgtttgccccttactgctcttctaggcctcattctaagccccttctccaagttgcctctccttatttctccctgtctgccaaaaaatctttcccagctcactaagtcagtctcacgcagtcactcattaacccaccaatcactgattgtgccggcacatgaatgcaccaggtgttgaagtggaggaattaaaaagtcagatgaggggtgtgcccagaggaagcaccattctagttgggggagcccatctgtcagctgggaaaagtccaaataacttcagattggaatgtgttttaactcagggttgagaaaacagccaccttcaggacaaaagtcagggaagggctctctgaagaaatgctacttgaagataccagccctaccaagggcagggagaggaccctatagaggcctgggacantttttttttttttttttttttgagatggagttttgctcttgttgcccaggctggagtgcaatggtgcatcttggctcactacaacctctgcctcccaggttcaagtgattctcctgcctcagcctcccaagtagctgggattacaggcacccaccaccatgcccggctaattttttgtatttttagtagagacagggtttcactatgttggccaggctggtctcgaactcctgacctcaggtgatccacccgcttcagcctcccaaagtgctgggattacaggcgtgagccaccacacccggcctgcttttcttaaagatcaatctgagtgctgtacggagagtgggttgtaagccaagagtagaagcagaaagggagcagttgcagcagagagatgatggaggcctgggcagggtggtggcagggaggtaaccaacaccattcaggtttcaaaggtagaaccatgcagggatgagaaagcaaagaggggatcaaggaaggcagctggattttggcctgagcagctgagtcaatgatagtgccgtttactaagaagaaaccaaggaaaaaatttggggtgcagggatcaaaactttttggaacatatgaaagtacgtgtttatactctttatggcccttgtcactatgtatgcctcgctgcctccattggactctagaatgaagccaggcaagagcagggtctatgtgtgatggcacatgtggccagggtcatgcaacatgtactttgtacaaacagtgtatattgagtaaatagaaatggtgtccaggagccgaggtatcggtcctgccagggccaggggctctccctagcaggtgctcatatgctgtaagttccctccagatctctccacaaggaggcatggaaaggctgtagttgttcacctgcccaagaactaggaggtctggggtgggagagtcagcctgctctggatgctgaaagaatgtctgtttttccttttagaaagttcctgtgatgtcaagctggtcgagaaaagctttgaaacaggtaagacaggggtctagcctgggtttgcacaggattgcggaagtgatgaacccgcaataaccctgcctggatgagggagtgggaagaaattagtagatgtgggaatgaatgatgaggaatggaaacagcggttcaagacctgcccagagctgggtggggtctctcctgaatccctctcaccgtctctgactttccgttctaagcactttgaggatgagtttctagcttcaatagaccaaggactctctcctaggcctctgtattcctttcaacagctccactgtcaagagagccagagagagcttctgggtggcccagctgtgaaatttctgagtcccttagggatagccctaaacgaaccagatcatcctgaggacagccaagaggttttgccttctttcaagacaagcaacagtactcacataggctgtgggcaatggtcctgtctctcaagaatcccctgccactcctcacacccaccctgggcccatattcatttccatttgagttgttcttattgagtcatccttcctgtggcagcggaactcactaaggggcccatctggacccgaggtattgtgaagataaattctgagcacctaccccatccccagaagggctcagaaataaaataagagccaagtctagtcggtgtttcctgtcttgaaacacaatactgttggccctggaagaatgcacagaatctgtttgtaaggggatatgcacagaagctgcaagggacaggaggtgcaggagctgcaggcctcccccacccagcctgctctgccttggggaaaaccgtgggtgtgtcctgcaggccatgcaggcctgggacatgcaagcccataaccgctgtggcctcttggttttacagatacgaacctaaactttcaaaacctgtcagtgattgggttccgaatcctcctcctgaaagtggccgggtttaatctgctcatgacgctgcggctgtggtccagctga

SEQ ID NO: 3878 - DNA, 2649 bp, Artificial Sequence
  Synthetic Polynucleotide encoding a targeting construct
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3879 - DNA, 2559 bp, Artificial Sequence
  Synthetic Polynucleotide encoding a targeting construct
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3880 - DNA, 2649 bp, Artificial Sequence
  Synthetic Polynucleotide encoding a targeting construct
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggaaaccaattcccaaccctcttctgggactggattcaaccggcagcggcgaggacctgaaaaacgtgttcccacccgaggtcgctgtgtttgagccatcagaagcagagatctcccacacccaaaaggccacactggtatgcctggccacaggcttctaccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggcagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3881 - DNA, 1926 bp, Artificial Sequence
  Synthetic Polynucleotide encoding a targeting construct
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggtcaaggaacctcagtcaccgtctcctcaacgcgtgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 3882 - DNA, 1956 bp, Artificial Sequence
  Synthetic Polynucleotide encoding a targeting construct
atggccttaccagtgaccgccttgctcctgccgctggccttgctgctccacgccgccaggccgcagtctgtggtcacacagcctccatccgtgtctgctgcccctggacagaaagtgaccatcagctgtagcggcagcagcagcaacatcggcaacaactacgtgtcctggtatcagcagctgcccggcacagctcccaaactgctgatctacgacaacaacaagcggcccagcggcatccccgatagattttctgccagcaagagcggcaccagcgccacactgggaatcacaggactccagaccagagatgaggccgactactactgcggcacctgggattcttctctgtccgcctgggttttcggcggaggcacaaaactgacagtgctcggactcgaggggaaaccaattcccaaccctcttctgggactggattcaaccggcagcggcgaggacctgaaaaacgtgttcccacccgaggtcgctgtgtttgagccatcagaagcagagatctcccacacccaaaaggccacactggtatgcctggccacaggcttctaccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggcagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctggttcagtctggggccgaagtgaagaaacctggcagcagcgtgaaggtgtcctgcaaggcttccggcgataccttcagcagctactacatcagctgggtccgacaggccccaggacaaggacttgagtggatgggcagaatcatccccatcctgggaatcgccaactacgcccagaaataccagggcagagtgaccctgagcgccgacaagagcacaagcaccagctacatggaactgaacagcctgagcagcgaggacaccgccgtgtactattgtgccctggactggtcctacagcatcgactattggggccagggcaccctggtcacagtctcttctacgcgtgagcagaaactgatctcggaagaggatgggagcggcatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctgtggtccagctga

SEQ ID NO: 3883 - DNA, 1854 bp, Artificial Sequence
  Synthetic Polynucleotide encoding a targeting construct
atggccttaccagtgaccgccttgctcctgccgctggccttgctgctccacgccgccaggccgaatgctggcgtgacccagacacctaagttccaggtgctgaaaaccggccagagcatgaccctgcaatgcgcccaggacatgaaccatgagtacatgagctggtacagacaggaccccggcatgggcctgagactgatccactactctgtggctatccagaccaccgaccagggcgaagtgcccaatggctacaacgtgtccagaagcaccatcgaggacttcccactgagactgctgtctgccgctcctagccagaccagcgtgtacttttgtgccagcagctacctgggcaacaccggcgagctgttttttggcgagggcagcagactgaccgtggaggacctgaaaaacgtgttcccacccgaggtcgctgtgtttgagccatcagaagcagagatctcccacacccaaaaggccacactggtatgcctggccacaggcttctaccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggcagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagaagtgacacagatccctgccgctctgtctgtgcctgagggcgaaaacctggtgctgaactgctccttcaccgacagcgccatctacaacctccagtggttcaggcaggaccctggaaagggactgacaagcctgctgctgatccagagcagccagagagagcagacctccggcagactgaatgccagcctggataagagcagcggcaggtctaccctgtatatcgccgcttctcagcctggcgatagcgccacatatctgtgtgctgtgcggcctacaagcggcggcagctacatccctacatttggcagaggcaccagcctgatcgtgcacccttatgatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctgtggtccagctga

SEQ ID NO: 3884 - DNA, 423 bp, Homo sapiens
gatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctgtggtccagc

SEQ ID NO: 3885 - DNA, 420 bp, Homo sapiens
atccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctgtggtccagc

SEQ ID NO: 3886 - DNA, 420 bp, Artificial Sequence
  Synthetic Polynucleotide encoding a TCR chain
atccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 3887 - DNA, 420 bp, Artificial Sequence
  Synthetic Polynucleotide encoding a TCR chain
atccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 3888 - DNA, 411 bp, Artificial Sequence
  Synthetic Polynucleotide encoding a TCR chain
cctgatcctgccgtgtaccagctgcgggatagcaagagcagcgacaagagcgtgtgcctgttcaccgacttcgacagccagaccaacgtgtctcagtctaaggatagtgatgtgtatatcaccgacaagaccgtgctggacatgcggagcatggacttcaagagcaacagcgccgtggcctggtccaacaagagcgacttcgcctgcgccaacgccttcaacaacagcatcatccccgaggacaccttcttccccagccccgagagcagctgcgacgtgaaactggtggagaagagcttcgagacagacaccaacctgaacttccagaacctgagcgtgatcggcttcagaatcctgctgctgaaggtggccggcttcaacctgctgatgaccctgcggctgtggagcagc

SEQ ID NO: 3889 - DNA, 420 bp, Artificial Sequence
  Synthetic Polynucleotide encoding a TCR chain
atccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 3890 - DNA, 411 bp, Artificial Sequence
  Synthetic Polynucleotide encoding a TCR chain
cctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 3891 - DNA, 420 bp, Artificial Sequence
  Synthetic Polynucleotide encoding a TCR chain
atccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 3892 - DNA, 420 bp, Artificial Sequence
  Synthetic Polynucleotide encoding a TCR chain
atccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaaccgcgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 3893 - DNA, 420 bp, Artificial Sequence
  Synthetic Polynucleotide encoding a TCR chain
atccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaaccgcgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 3894 - DNA, 420 bp, Artificial Sequence
  Synthetic Polynucleotide encoding a TCR chain
atccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagcagcgacagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 3895 - DNA, 531 bp, Homo sapiens
gaggacctgaacaaggtgttcccacccgaggtcgctgtgtttgagccatcagaagcagagatctcccacacccaaaaggccacactggtgtgcctggccacaggcttcttccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcagactgtggctttacctcggtgtcctaccagcaaggggtcctgtctgccaccatcctctatgagatcctgctagggaaggccaccctgtatgctgtgctggtcagcgcccttgtgttgatggccatggtcaagagaaaggatttc

SEQ ID NO: 3896 - DNA, 537 bp, Homo sapiens
gaggacctgaaaaacgtgttcccacccgaggtcgctgtgtttgagccatcagaagcagagatctcccacacccaaaaggccacactggtatgcctggccacaggcttctaccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggc

SEQ ID NO: 3897 - DNA, 537 bp, Homo sapiens; identical to SEQ ID NO: 3896

SEQ ID NO: 3898 - DNA, 537 bp, Artificial Sequence
  Synthetic Polynucleotide encoding a TCR chain
gaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 3899 - DNA, 537 bp, Artificial Sequence
  Synthetic Polynucleotide encoding a TCR chain
gaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 3900 - DNA, 537 bp, Artificial Sequence
  Synthetic Polynucleotide encoding a TCR chain
gaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 3901 - DNA, 537 bp, Artificial Sequence
  Synthetic Polynucleotide encoding a TCR chain
gaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 3902 - DNA, 537 bp, Artificial Sequence
  Synthetic Polynucleotide encoding a TCR chain
gaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 3903 - DNA, 537 bp, Artificial Sequence
  Synthetic Polynucleotide encoding a TCR chain
gaggacctgaagaacgtgttcccacctgaggtggccgtgttcgagcctagcaaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 3904 - DNA, 537 bp, Artificial Sequence
  Synthetic Polynucleotide encoding a TCR chain
gaggacctgaagaacgtgttcccacctgaggtggccgtgttcgagcctagcaaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgccagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 3905 - DNA, 537 bp, Artificial Sequence
  Synthetic Polynucleotide encoding a TCR chain
gaggacctgaagaacgtgttcccacctgaggtggccgtgttcgagcctagcaaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccaccagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 3906 - DNA, 537 bp, Artificial Sequence
  Synthetic Polynucleotide encoding a TCR chain
gaggacctgaagaacgtgttcccacctgaggtggccgtgttcgagcctagcagggccgagatcgcccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 3907 - DNA, 537 bp, Artificial Sequence
  Synthetic Polynucleotide encoding a TCR chain
gaggacctgaagaacgtgttcccacctgaggtggccgtgttcgagcctagcagggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 3908 - DNA, 537 bp, Artificial Sequence
  Synthetic Polynucleotide encoding a TCR chain
gaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcggactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 3909 - DNA, 537 bp, Artificial Sequence
  Synthetic Polynucleotide encoding a TCR chain
gaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcggactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 3910 - DNA, 537 bp, Artificial Sequence
  Synthetic Polynucleotide encoding a TCR chain
gaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcggactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 3911 - DNA, 567 bp, Homo sapiens
gataaacaacttgatgcagatgtttcccccaagcccactatttttcttccttcaattgctgaaacaaaactccagaaggctggaacatacctttgtcttcttgagaaatttttcccagatattattaagatacattggcaagaaaagaagagcaacacgattctgggatcccaggaggggaacaccatgaagactaacgacacatacatgaaatttagctggttaacggtgccagaagagtcactggacaaagaacacagatgtatcgtcagacatgagaataataaaaacggaattgatcaagaaattatctttcctccaataaagacagatgtcaccacagtggatcccaaatacaattattcaaaggatgcaaatgatgtcatcacaatggatcccaaagacaattggtcaaaagatgcaaatgatacactactgctgcagctcacaaacacctctgcatattacatgtacctcctcctgctcctcaagagtgtggtctattttgccatcatcacctgctgtctgcttggaagaacggctttctgctgcaatggagagaaatca

SEQ ID NO: 3912 - DNA, 519 bp, Homo sapiens
gacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtct

SEQ ID NO: 3913 - DNA, 459 bp, Homo sapiens
agtcagcctcataccaaaccatccgtttttgtcatgaaaaatggaacaaatgtcgcttgtctggtgaaggaattctaccccaaggatataagaataaatctcgtgtcatccaagaagataacagagtttgatcctgctattgtcatctctcccagtgggaagtacaatgctgtcaagcttggtaaatatgaagattcaaattcagtgacatgttcagttcaacacgacaataaaactgtgcactccactgactttgaagtgaagacagattctacagatcacgtaaaaccaaaggaaactgaaaacacaaagcaaccttcaaagagctgccataaacccaaagccatagttcataccgagaaggtgaacatgatgtccctcacagtgcttgggctacgaatgctgtttgcaaagactgttgccgtcaattttctcttgactgccaagttatttttcttg

SEQ ID NO: 3914 - protein, 21 aa, Artificial Sequence
  Synthetic Polypeptide
MALPVTALLLPLALLLHAARP

SEQ ID NO: 3915 - protein, 21 aa, Artificial Sequence
  Synthetic Polypeptide
MALPVTALLLPLALLLHAARP

SEQ ID NO: 3916 - protein, 21 aa, Artificial Sequence
  Synthetic Polypeptide
MALPVTALLLPLALLLHAARP

SEQ ID NO: 3917 - protein, 21 aa, Artificial Sequence
  Synthetic Polypeptide
MALPVTALLLPLALLLHAARP

SEQ ID NO: 3918 - protein, 19 aa, Artificial Sequence
  Synthetic Polypeptide
MDWIWRILFLVGAATGAHS

SEQ ID NO: 3919 - protein, 19 aa, Artificial Sequence
  Synthetic Polypeptide
MDWIWRILFLVGAATGAHS

SEQ ID NO: 3920 - protein, 19 aa, Artificial Sequence
  Synthetic Polypeptide
MDWIWRILFLVGAATGAHS

SEQ ID NO: 3921 - protein, 19 aa, Artificial Sequence
  Synthetic Polypeptide
MDWIWRILFLVGAATGAHS

SEQ ID NO: 3922 - protein, 20 aa, Artificial Sequence
  Synthetic Polypeptide
MRLPAQLLGLLMLWVSGSSG

SEQ ID NO: 3923 - protein, 20 aa, Artificial Sequence
  Synthetic Polypeptide
MPPPRLLFFLLFLTPMEVRP

SEQ ID NO: 3924 - protein, 111 aa, Artificial Sequence
  Synthetic Polypeptide
QSVLTQPASVSGSPGQSITISCTGTSSDVGGYNYVSWYQQHPGKAPKLMIYDVNNRPSEVSNRFSGSKSGNTASLTISGLQAEDEADYYCSSYTTGSRAVFGGGTKLTVLG

SEQ ID NO: 3925 - protein, 110 aa, Artificial Sequence
  Synthetic Polypeptide
QSVVTQPPSVSAAPGQKVTISCSGSSSNIGNNYVSWYQQLPGTAPKLLIYDNNKRPSGIPDRFSGSKSGTSATLGITGLQTGDEADYYCGTWDGSLYTMLFGGGTKLTVL

SEQ ID NO: 3926 - protein, 113 aa, Artificial Sequence
  Synthetic Polypeptide
QSVLTQPPSVSGAPGQRVTISCTGSSSNIGAGYDVHWYQQLPGTAPKLLIFGNSNRPSGVPDRFSGFKSGTSASLAITGLQAEDEADYFCQSYDSSLSGSGVFGTGTKVTVLG

SEQ ID NO: 3927 - protein, 111 aa, Artificial Sequence
  Synthetic Polypeptide
DVQMIQTPDSLAVSLGQRATISCRASESVDNYGISFMHWYQQKPGQSPKLLIYRASNLESGIPARFSGSGSRTDFTLTINPVETDDVATYYCQQNNKDPPTFGGGTKLEIK

SEQ ID NO: 3928 - protein, 107 aa, Artificial Sequence
  Synthetic Polypeptide
DVQMIQTPSSLSASLGDRVTISCRASQDIGNYLNWYQQKPDGTVKLLIYYTSRLHSGVPSRFSGSGSGTEYSLTISNLEQEDIATYFCQQGSALPPTFGGGTKLEIN

SEQ ID NO: 3929 - protein, 112 aa, Artificial Sequence
  Synthetic Polypeptide
DVVMTQSPLSLPVTPGAPASISCRSSQSIVHSNGNTYLEWYLQKPGQSPKLLIYKVSNRFSGVPDRFSGSGSGTDFTLRISRVEAEDVGIYYCFQGSHVPPTFGPGTKLEIK

SEQ ID NO: 3930 - protein, 112 aa, Artificial Sequence
  Synthetic Polypeptide
QSVLTQPPSVSGAPGQRVTISCTGSSSNIGAGFDVHWYQQLPGTAPKLLIYGNSNRPSGVPDRFSGSKSGTSASLAITGLQAEDEADYYCQSYDSSLSGYVFGTGTKVTVLG

SEQ ID NO: 3931 - protein, 111 aa, Artificial Sequence
  Synthetic Polypeptide
QAVLTQPPSASGTPGQRVTISCSGSSSNIGSYTVSWYQQLPGTAPKFLIYSNNQRPSGVPDRFSGSKSGTSASLAISGLQSEDEADYYCAAWDDSLNGYVFGTGTKVTVLG

SEQ ID NO: 3932 - protein, 112 aa, Artificial Sequence
  Synthetic Polypeptide
DIVLTQSPATLSLSPGDRATISCRASESVTILGSHLIYWYQQKPGQPPRLLIQLASNVQTGVPARFSGSGSRTDFTLTISSVEPEDFAVYYCLQSRTIPRTFGQGTKLEIKR

SEQ ID NO: 3933 - protein, 108 aa, Artificial Sequence
  Synthetic Polypeptide
DIQMTQSPSSLSASVGDRVTITCSASQDISNYLNWYQQKPGKAPKLLIYYTSNLHSGVPSRFSGSGSGTDFTLTISSLQPEDFATYYCQQYRKLPWTFGQGTKLEIKR

SEQ ID NO: 3934 - protein, 114 aa, Artificial Sequence
  Synthetic Polypeptide
LPVLTQPPSASGTPGQRVTISCSGRSSNIGSNSVNWYRQLPGAAPKLLIYSNNQRPPGVPVRFSGSKSGTSASLAISGLQSEDEATYYCATWDDNLNVHYVFGTGTKVTVLGSR

SEQ ID NO: 3935 - protein, 111 aa, Artificial Sequence
  Synthetic Polypeptide
DIVLTQSPASLAVSLGERATINCRASESVSVIGAHLIHWYQQKPGQPPKLLIYLASNLETGVPARFSGSGSGTDFTLTISSLQAEDAAIYYCLQSRIFPRTFGQGTKLEIK

SEQ ID NO: 3936 - protein, 112 aa, Artificial Sequence
  Synthetic Polypeptide
DIVLTQSPATLSLSPGDRATLSCRASESVTILGSHLIYWYQQKPGQAPRLLIQLASNVQTGIPARFSGSGSRTDFTLTISSLEPEDFAVYYCLQSRTIPRTFGQGTKLEIKR

SEQ ID NO: 3937 - protein, 112 aa, Artificial Sequence
  Synthetic Polypeptide
DIVMTQSPDSLAVSLGERATINCKSSQSILYSSNQKNYLAWYQQKPGQSPKLLIYWASTRESGVPDRFSGSGSGTDFTLTISSLQAEDVAVYYCHQYISSYTFGQGTKLEIK

SEQ ID NO: 3938 - protein, 114 aa, Artificial Sequence
  Synthetic Polypeptide
DIVMTQSPDSLAVSLGERATINCESSQSLLNSGNQKNYLTWYQQKPGQPPKPLIYWASTRESGVPDRFSGSGSGTDFTLTISSLQAEDVAVYYCQNDYSYPYTFGQGTKLEIKR

SEQ ID NO: 3939 - protein, 111 aa, Artificial Sequence
  Synthetic Polypeptide
DIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELK

SEQ ID NO: 3940 - protein, 113 aa, Artificial Sequence
  Synthetic Polypeptide
DFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIK

SEQ ID NO: 3941 - protein, 113 aa, Artificial Sequence; identical to SEQ ID NO: 3940
  Synthetic Polypeptide

SEQ ID NO: 3942 - protein, 109 aa, Artificial Sequence
  Synthetic Polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQDYGFPWTFGQGTKVEIKR

SEQ ID NO: 3943 - protein, 111 aa, Artificial Sequence
  Synthetic Polypeptide
QFVLTQPPSVSTNPGSTVKLSCKRNTGNIGSNYVNWYQQKPGQSPTTMIYRDDKRPDGVPDRFSGSIDRSSNSALLTINNVQTEDEADYFCQSYSSGINIIFGGGTKLTVL

SEQ ID NO: 3944 - protein, 107 aa, Artificial Sequence
  Synthetic Polypeptide
DIQMTQSPASLSASLGETVTIECRPSEDIHSNVAWYQQKPGNSPQLLIYDASNLADGVPSRFSGSGSGTQYSLKINSLQSEDVASYFCHQYNIYPYTFGSGTKLELK

SEQ ID NO: 3945 - protein, 108 aa, Artificial Sequence
  Synthetic Polypeptide
EIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGQGTKVEIKR

SEQ ID NO: 3946 - protein, 108 aa, Artificial Sequence
  Synthetic Polypeptide
DVQITQSPSYLAASPGETITINCRASKSISKDLAWYQEKPGKTNKLLIYSGSTLQSGIPSRFSGSGSGTDFTLTISSLEPEDFAMYYCQQHNKYPYTFGGGTKLEIKR

SEQ ID NO: 3947 - protein, 107 aa, Artificial Sequence
  Synthetic Polypeptide
DIQMTQSPASLSASLGETVTIECRTSKDIYSNLAWFQQEPGNSPQLLIYDASNLADGVPSRFSGSGSGTQYSLQINNLQSEDVASYFCHQYNNYPYTFGTGTKLELK

SEQ ID NO: 3948 - protein, 106 aa, Artificial Sequence
  Synthetic Polypeptide
EIVLTQSPTSMTASPGEQVTITCRASSSINYMHWYQQKPGASPRPWIYETSKLASGVPDRFSGSASGTSYSLTINNMEAEDAATYYCQQWNYPSWTFGGGTKLELK

SEQ ID NO: 3949 - protein, 113 aa, Artificial Sequence
  Synthetic Polypeptide
DIVMTQSPSSLAVSEGETVTINCKSSQSFLSSGDGKNYVAWYQYKPGQSPKLLIYWASTRQSGVPDRFIGSGSGTDFTLTISTVQAEDLAIYYCQQYYDTPLTFGSGTKLEIK

SEQ ID NO: 3950 - protein, 113 aa, Artificial Sequence
  Synthetic Polypeptide
DVLMTQTPVSLPVSLGGQVSISCRSSQSLVHSDGDTYLHWYLQKPGQSPQLLIYRVSNRFSGVPDRFSGSGSGTDFTLKISRVEPEDLGLYYCLQTTHFPPWTFGGGTKLEMK

SEQ ID NO: 3951 - protein, 107 aa, Artificial Sequence
  Synthetic Polypeptide
DIQMTQSTSSLSASLGDRVTISCSASQGINNYLNWYQQKPDGTVELLIYYTSTLQSGVPSRFSGSGSGTDYSLTISNLEPEDIGTYYCQQYSKLPRTFGGGTKLEIK

SEQ ID NO: 3952 - protein, 106 aa, Artificial Sequence
  Synthetic Polypeptide
DIQMTQSPASLSVSVGETVTITCRASENIYSNLAWYQQKQGKSPQLLVYAATNLADGVPSRFSGSGSGTQYSLKINSLQSEDFGSYYCQHFWGTWTFGGGTTLEIK

SEQ ID NO: 3953 - protein, 113 aa, Artificial Sequence
  Synthetic Polypeptide
DIVMTQAAPSIPVTPGESVSISCRSSKSLLNSNGNTYLYWFLQRPGQSPQLLIYRMSNLASGVPDRFSGSGSGTAFTLRISRVEAEDVGVYYCMQHLEYPFTFGAGTKLELKR

SEQ ID NO: 3954 - protein, 107 aa, Artificial Sequence
  Synthetic Polypeptide
EIVLTQSPATLSLSPGERATLSCSASSSVSYMHWYQQKPGQAPRLLIYDTSKLASGIPARFSGSGSGTDFTLTISSLEPEDVAVYYCFQGSVYPFTFGQGTKLEIKR

SEQ ID NO: 3955 - protein, 111 aa, Artificial Sequence
  Synthetic Polypeptide
DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIK

SEQ ID NO: 3956 - protein, 107 aa, Artificial Sequence
  Synthetic Polypeptide
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEIT

SEQ ID NO: 3957 - protein, 107 aa, Artificial Sequence; identical to SEQ ID NO: 3956
  Synthetic Polypeptide

SEQ ID NO: 3958 - protein, 107 aa, Artificial Sequence; identical to SEQ ID NO: 3956
  Synthetic Polypeptide

SEQ ID NO: 3959 - protein, 107 aa, Artificial Sequence
  Synthetic Polypeptide
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 3960 - protein, 111 aa, Artificial Sequence
  Synthetic Polypeptide
EIVLTQSPDFQSVTPKEKVTITCRASESVDTFGISFMNWFQQKPDQSPKLLIHAASNQGSGVPSRFSGSGSGTDFTLTINSLEAEDAATYYCQQSKEVPFTFGGGTKVEIK

SEQ ID NO: 3961 - protein, 107 aa, Artificial Sequence
  Synthetic Polypeptide
AIQLTQSPSSLSASVGDRVTITCRASQGISSAQQKPGKAPKLLILAWYSSLESGVPSRFSGYDASGSGTDFTLTISSLQPEDFATYYCQQFNSYPYTFGQGTKLEIK

SEQ ID NO: 3962 - protein, 112 aa, Artificial Sequence
  Synthetic Polypeptide
DIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIK

SEQ ID NO: 3963 - protein, 111 aa, Artificial Sequence
  Synthetic Polypeptide
DILLTQSPATLSLSPGERATLSCRASQSVDYDGDSYLNWYQQKPGQPPKLLIYDASNLVSGIPPRFSGSGSGTDFTLTISRLEPEDFAVYHCQQSTEDPWTFGGGTKLEIK

SEQ ID NO: 3964 - protein, 111 aa, Artificial Sequence
  Synthetic Polypeptide
DILLTQSPATLSLSPGERATLSCRASQSVDNYGISFMNWYQQKPGQPPKLLIYAASNQGSGIPSRFSGSGSGTDFTLTISSLEPEDFAMYFCQQSNEVPRTFGGGTKLEIK

SEQ ID NO: 3965 - protein, 109 aa, Artificial Sequence
  Synthetic Polypeptide
DILLTQSPATLSLSPGERATLSCKASQNVGTNVAWYQQKPGQPPKLLIYSATYRNSGIPARFSGSGSGTEFTLTITNVQSKDLADYFYFCQYNRYPYTSGGGTKLEIKR

SEQ ID NO: 3966 - protein, 104 aa, Artificial Sequence
  Synthetic Polypeptide
QIVLTQSPATLSASPGEKATMTCSASSGVNYMHWYQQKPGTSPKRWIYDTDKTASGVPARFSGSGSGTSYSLTISSMEAEDAATYYCHQRGSYTFGGGTKLEIK

SEQ ID NO: 3967 - protein, 108 aa, Artificial Sequence
  Synthetic Polypeptide
DIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKR

SEQ ID NO: 3968 - protein, 112 aa, Artificial Sequence
  Synthetic Polypeptide
DIQLTQSPSSLSASVGDRVTITCKASQSVDYDGDSYLNWYQQIPGKAPKLLIYDASNLVSGIPPRFSGSGSGTDYTFTISSLQPEDIATYHCQQSTEDPWTFGGGTKLQIKR

SEQ ID NO: 3969 - protein, 107 aa, Artificial Sequence
  Synthetic Polypeptide
EIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIK

SEQ ID NO: 3970 - protein, 113 aa, Artificial Sequence
  Synthetic Polypeptide
DIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKR

SEQ ID NO: 3971 - protein, 107 aa, Artificial Sequence
  Synthetic Polypeptide
DIVLTQSPAIITASPGEKVTMTCRASSSVNYMDWYQKKPGSSPKPWIYATSNLASGVPSRFSGSGSGTTYSMTISSLEAEDAATYYCQQWSFNPPTFGGGTKLEIKR

SEQ ID NO: 3972 - protein, 107 aa, Artificial Sequence
  Synthetic Polypeptide
EIVLTQSPATLSLSPGERATLSCRASQSVSSYLAWYQQKPGQAPRLLIYDASNRATGIPARFSGSGSGTDFTLTISSLEPEDFAVYYCQQRSDWPLTFGGGTKVEIK

SEQ ID NO: 3973 - protein, 107 aa, Artificial Sequence
  Synthetic Polypeptide
EIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGGGTKVEIK

SEQ ID NO: 3974 - protein, 107 aa, Artificial Sequence
  Synthetic Polypeptide
DIQMTQSPSSLSASVGDRVTITCRASSSVSYMHWYQQKPGKAPKPLIYAPSNLASGVPSRFSGSGSGTDFTLTISSLQPEDFATYYCQQWSFNPPTFGQGTKVEIKR

SEQ ID NO: 3975 - protein, 106 aa, Artificial Sequence
  Synthetic Polypeptide
DIQLTQSPSSLSASVGDRVTMTCRASSSVSYIHWFQQKPGKAPKPWIYATSNLASGVPVRFSGSGSGTDYTFTISSLQPEDIATYYCQQWTSNPPTFGGGTKLEIK

SEQ ID NO: 3976 - protein, 111 aa, Artificial Sequence
  Synthetic Polypeptide
STVMTQSPDSLAVSLGERATINCKSSQSNSNDVAWYQQKPGQSPKVLIYFASNRYSGVPDRFSGSGYGTDFTLTISSLQAEDVAVYFCQQDYSSPLTFGAGTKLELKRADA

SEQ ID NO: 3977 - protein, 111 aa, Artificial Sequence
  Synthetic Polypeptide
QIVLSQSPAILSASPGEKVTMTCRASSSVSYMHWYQQKPGSSPKPWIYATSNLASGVPARFSGSGSGTSYSFTISRVEAEDAATYYCQQWTFNPPTFGGGTRLEIKRTVAA

SEQ ID NO: 3978 - protein, 107 aa, Artificial Sequence; identical to SEQ ID NO: 3974
  Synthetic Polypeptide

SEQ ID NO: 3979 - protein, 106 aa, Artificial Sequence
  Synthetic Polypeptide
EIVLTQSPSSLSASVGDRVTITCRASSSLSFMHWYQQKPGKAPKPWIYATSNLASGVPSRFSGSGSGTDYTLTISSLQPEDFATYFCHQWSSNPLTFGGGTKVEIK

SEQ ID NO: 3980 - protein, 107 aa, Artificial Sequence; identical to SEQ ID NO: 3969
  Synthetic Polypeptide

SEQ ID NO: 3981 - protein, 107 aa, Artificial Sequence
  Synthetic Polypeptide
EIVLTQSPGTLSLSPGERATLSCRASSSVPYIHWYQQKPGQAPRLLIYATSALASGIPDRFSGSGSGTDFTLTISRLEPEDFAVYYCQQWLSNPPTFGQGTKLELKR

SEQ ID NO: 3982 - protein, 113 aa, Artificial Sequence
  Synthetic Polypeptide
DIQMTQSPSSLSASVGDRVTITCRSSQSIVHSVGNTFLEWYQQKPGKAPKLLIYKVSNRFSGVPSRFSGSGSGTDFTLTISSLQPEDFATYYCFQGSQFPYTFGQGTKVEIKR

SEQ ID NO: 3983 - protein, 108 aa, Artificial Sequence
  Synthetic Polypeptide
DIVMTQSPSSLSASVGDRVTITCKASQSVTNDVAWYQQKPGKAPKLLIYYASNRYTGVPSRFSGSGSGTDFTLTISSLQPEDFATYYCQQDYRSPWTFGGGTKVEIKR

SEQ ID NO: 3984 - protein, 107 aa, Artificial Sequence
  Synthetic Polypeptide
DIQMTQSPSSLSASVGDRVTITCRASQTIWSYLNWYQQRPGKAPNLLIYAASSLQSGVPSRFSGRGSGTDFTLTISSLQAEDFATYYCQQSYSIPQIFGQGTKLEIK

SEQ ID NO: 3985 - protein, 110 aa, Artificial Sequence
  Synthetic Polypeptide
EIVLTQSPGTLSLSPGERATLSCRASQSVGGYLAWYQQKPGQAPRLLIYDASNRATGIPARFSGSGSGTDFTLTISSLEPEDFAVYYCQQRNNWPPMYTFGQGTKLEIKR

SEQ ID NO: 3986 - protein, 112 aa, Artificial Sequence
  Synthetic Polypeptide
DIQMTQSPATIENTSLSASVGDRVTITCRASQGISSWLTWYQQKPEKAPKSLIYAASSLQSGVPSRFSGSGSGTDFTLTISSLQPEDFATYYCQQYDSYPITFGQGTRLEIK

SEQ ID NO: 3987 - protein, 112 aa, Artificial Sequence
  Synthetic Polypeptide
DEIVLTQSPDSLAVSLGERATINCKASQSVDFDGDSYLNWYQQKPGQPPKVLIYAASTLQSGVPSRFSGSGSGTDFTLTINSLEAEDAATYYCQQSNEDPWTFGGGTKVEIK

SEQ ID NO: 3988 - protein, 107 aa, Artificial Sequence
  Synthetic Polypeptide
DIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIK

SEQ ID NO: 3989 - protein, 112 aa, Artificial Sequence
  Synthetic Polypeptide
DVVMTQSPLSLPVTLGQPASISCRSSQSIVHSDGNTYLEWYQQRPGQSPRRLIYKVSNRFSGVPDRFSGSGSGTDFTLKISRVEAEDVGVYYCFQGSHAPWTFGGGTKVEIK

SEQ ID NO: 3990 - protein, 106 aa, Artificial Sequence
  Synthetic Polypeptide
QIVLTQSPALMSASPGEKVTMTCSASSSVRYMYWYQQKPRSSPKPWIHLTSNLASGVPARFSGSGSGTSYSLTISSMEAEDAATYYCQQWSSHPFTFGSGTKLEIK

SEQ ID NO: 3991 - protein, 113 aa, Artificial Sequence
  Synthetic Polypeptide
EIVLTQSPGSLAVSPGERVTMSCKSSQSVFFSSSQKNYLAWYQQIPGQSPRLLIYWASTRESGVPDRFTGSGSGTDFTLTISSVQPEDLAIYYCHQYLSSRTFGQGTKLEIKR

SEQ ID NO: 3992 - protein, 114 aa, Artificial Sequence
  Synthetic Polypeptide
DDIVMTQSPDSLTVSLGERTTINCKSSQSVLDSSKNKNSLAWYQQKPGQPPKLLLSWASTRESGIPDRFSGSGSGTDFTLTIDSLQPEDSATYYCQQSAHFPITFGQGTRLEIK

SEQ ID NO: 3993 - protein, 111 aa, Artificial Sequence
  Synthetic Polypeptide
DIQLTQSPSSLSASVGDRVTITCRASQGISSVLAWYQQKPGKAPKLLIYDASSLESGVPSRFSGSGSGTDFTLTISSLQPEDFATYYCQQFNSSITFGQGTKLEIKRTVAA

SEQ ID NO: 3994 - protein, 107 aa, Artificial Sequence
  Synthetic Polypeptide
DIVMTQSPSSLSASLGGKVTITCKASQDINKYIAWYQHKPGKGPRLLIHYTSTLQPGIPSRFSGSGSGRDYSFSISNLEPEDIATYYCLQYDNLLTFGAGTKLELKR

SEQ ID NO: 3995 - protein, 107 aa, Artificial Sequence
  Synthetic Polypeptide
DIQMTQSPSSLSASVGDRVTINCKASQDINSYLSWFQQKPGKAPKTLIYRANRLVDGVPSRFSGSGSGQDYTLTISSLQPEDFATYYCLQYDEFPLTFGGGTKVEIK

SEQ ID NO: 3996 - protein, 112 aa, Artificial Sequence
  Synthetic Polypeptide
EIVLTQSPLSLPVTPGEPASISCRSSQSLLHSNGYNYLDWYLQKPGQSPQLLIYLGVNSVSGVPDRFSGSGSGTDFTLKISRVEAEDVGVYYCMQALQTPWTFGQGTKVEIK

SEQ ID NO: 3997 - protein, 111 aa, Artificial Sequence
  Synthetic Polypeptide
DIQMTQSPASLTVSLGQRATISCRASESVDSYGNSYLHWYQQKPGQPPQLLIYLASNLESGVPARFSGSGSRTDFTLTIDPVEADDAATYYCQQNNEDPWTFGGGTKVEIK

SEQ ID NO: 3998 - protein, 107 aa, Artificial Sequence
  Synthetic Polypeptide
DIQMTQSPSSLSASVGDRVTITCRASQGIRNDLGWYQQKPGKAPKRLIYAASSLQSGVPSRFSGSGSGTEFTLTISSLQPEDFATYYCLQHNSYPWTFGQGTKLEIK

SEQ ID NO: 3999 - protein, 114 aa, Artificial Sequence
  Synthetic Polypeptide
DVLLTQSPLSLPVTLGQPASISCRSSQTIVHSNGNTYLEWFQQRPGQSPRLLIYQVSNRFSGVPDRFSGSGSGTDFTLKISRVEAEDVGVYYCFQGSHVPRTFGGGTKVEIKRA

SEQ ID NO: 4000 - protein, 113 aa, Artificial Sequence
  Synthetic Polypeptide
DVLLTQSPLSLPVTLGQPASISCRSSQTIVHSNGNTYLEWFQQRPGQSPRLLIYQVSNRFSGVPDRFSGSGSGTDFTLKISRVEAEDVGVYYCFQGSHVPRTFGGGTKVEIKR

SEQ ID NO: 4001 - protein, 106 aa, Artificial Sequence
  Synthetic Polypeptide
EIVLTQSPATLSLSPGERATLSCSASSSINYIYWLQQKPGQAPRILIYLTSNLASGVPARFSGSGSGTDFTLTISSLEPEDFAVYYCLQWSSNPLTFGGGTKVEIK

SEQ ID NO: 4002 - protein, 108 aa, Artificial Sequence
  Synthetic Polypeptide
HIVLTQSPSSLSASLGDRVTISCRASQDISTYLNWYQQKPDGTVKLLIFYTSRLHAGVPSRFSGSGSGTHHSLTISNLEQEDIATYFCQQGNSLPFTFGSGTKLEIKR

SEQ ID NO: 4003 - protein, 109 aa, Artificial Sequence
  Synthetic Polypeptide
DHIVLTQSPSSLSASLGDRVTISCRASQDISTYLNWYQQKPDGTVKLLIFYTSRLHAGVPSRFSGSGSGTHHSLTISNLEQEDIATYFCQQGNSLPFTFGSGTKLEIKR

SEQ ID NO: 4004 - protein, 112 aa, Artificial Sequence
  Synthetic Polypeptide
DIVMTQSPDSLAVSLGERATINCRASKSVSTSGYSFMHWYQQKPGQPPKLLIYLASNLESGVPDRFSGSGSGTDFTLTISSLQAEDVAVYYCQHSREVPWTFGQGTKVEIKR

SEQ ID NO: 4005 - protein, 113 aa, Artificial Sequence
  Synthetic Polypeptide
DIVMTQTPLTLSVTIGQPASISCKSSQSLLDSDGKTYLNWLLQRPGQSPERLIYLVSKLDSGVPDRFTGSGSGTDFTLKISRVEAEDLGVYCCWQGTHFPYTFGGGTKVEIKG

SEQ ID NO: 4006 - protein, 113 aa, Artificial Sequence
  Synthetic Polypeptide
DDIQLTQSPSSLSASVGDRVTITCKASQSVDYEGDSFLNWYQQKPGKAPKLLIYAASNLESGVPSRFSGSGSGTDFTLTISSLQPEDFATYYCQQSNEDPLTFGQGTKVEIKR

SEQ ID NO: 4007 - protein, 112 aa, Artificial Sequence
  Synthetic Polypeptide
DIVMTQTPLSLSVTPGQPASISCKSSQSLLDGDGKTYLNWLLQKPGQSPQRLIYLVSKLDSGVPDRFSGSGSGTDFTLKISRVEAEDVGVYYCWQGTHFPRTFGQGTKLEIK

SEQ ID NO: 4008 - protein, 114 aa, Artificial Sequence
  Synthetic Polypeptide
DIVMSQSPSSLAVSVGEKVTMSCKSSQSLLHSSNQKNYLAWYQQKPGQSPKVLIYWASTRESGVPDRFTGSGSGTDFTLTITSVKSEDLAVYYCQQYYSYPWTFGGGTRLEIKR

SEQ ID NO: 4009 - protein, 109 aa, Artificial Sequence
  Synthetic Polypeptide
EIVLTQSPGTLSLSPGERATLSCRASQSVSSSYLAWYQQKPGQAPRLLIYGTSSRATGIPDRFSGSGSGTDFTLTISRLEPEDFAVYYCQQYGSSPFTFGGGTKVEIKR

SEQ ID NO: 4010 - protein, 108 aa, Artificial Sequence
  Synthetic Polypeptide
DIQMTQSPSSLSASVGDRVTITCRASQSISLWLNWYQQKPGKAPKLLIYAASTLQSGVPSRFSGSGSGTDFTLTISSLQPEDFATYYCQQYYTSPYTFGQGTKVEIKR

SEQ ID NO: 4011 - protein, 109 aa, Artificial Sequence
  Synthetic Polypeptide
DIQMTQSPSSLSASVGDRVTITCRASQSISSYLNWYQQKPGKAPKLLIYAVSTLQSGVPSRFSGSGSGTDFTLTISSLQPEDFATYYCQQSGTFPPTTFGQGTKVEIKR

SEQ ID NO: 4012 - protein, 106 aa, Artificial Sequence
  Synthetic Polypeptide
QSPSSLAVSAGEKVTMSCKSSQSLLNSRTRKNYLAWYQQKPGQSPKLLIYWASTRESGVPDRFTGSGSGTDFTLTISSVQAEDLAVYYCKQSNLYTFGGGTKLEIK

SEQ ID NO: 4013 - protein, 104 aa, Artificial Sequence
  Synthetic Polypeptide
MTQSPKFLLVSAGDRVTLTCKASQSVNNDVYWYQQEPGQSPKLLIYWASTRESGVPDRFTGSGSGTDFTLTISSVQAEDLAVYYCKQSYNLYTFGGGTKLEIKR

SEQ ID NO: 4014 - protein, 107 aa, Artificial Sequence
  Synthetic Polypeptide
DIQMTQSPSSLSASLGERVSLTCRATQELSGYLSWLQQKPDGTIKRLIYAASTLDSGVPKRFSGNRSGSDYSLTISSLESEDFADYYCLQYAIYPYTFGGGTKLEIK

SEQ ID NO: 4015 - protein, 112 aa, Artificial Sequence
  Synthetic Polypeptide
DTIVLTQSPASLAVSLGQRATISCRASESVDSYGNSFMHWYQQKPGQPPKLLIYLASNLESGVPARFSGSGSRTDFTLTIDPVEADDAATYYCQQNNYDPWTFGGGTKLEIK

SEQ ID NO: 4016 - protein, 106 aa, Artificial Sequence
  Synthetic Polypeptide
DIQMTQSPSSLSASVGDRVTITCKASQDVSTAVAWFQQKPGKAPKLLIYSPSYRYTGVPSRFSGSGSGTDFTLTISSLQPEDFTYYCQQLYSTPYTFGQGTKVEIK

SEQ ID NO: 4017 - protein, 111 aa, Artificial Sequence
  Synthetic Polypeptide
DIQMTQSPSSLSASVGDRVTITCRASQSVSTSSYNYMHWYQQKPGKPPKLLIKYASNLESGVPSRFSGSGSGTDFTLTISSLQPEDFATYYCQHSWEIPLTFGQGTKVEIK

SEQ ID NO: 4018 - protein, 108 aa, Artificial Sequence
  Synthetic Polypeptide
EIVLTQSPATLSASPGERVTLTCRASSNVISSYVHWYQQKPGSSPRLFLYSTSNLASGVPSRFSGSGSGTDFTFTISSLEAEDAATYYCQQYSGYPLTFGQGTRLEIK

SEQ ID NO: 4019 - protein, 108 aa, Artificial Sequence
  Synthetic Polypeptide
EIVLTQSPATLSLSPGERATLSCRASSNVISSYVHWYQQKPGQAPRLLIYSTSNLASGIPARFSGSGSGTDFTLTISSLEPEDFAVYYCQQYSGYPLTFGQGTRLEIK

SEQ ID NO: 4020 - protein, 120 aa, Artificial Sequence
  Synthetic Polypeptide
LNFMLTQPHSVSGSPGKTVTISCTRSTGSITSNYVHWYQQRPGSSPTTVICEDNERPSGVPDRFSGSIDISSNSASLTISGLKTEDEADYYCQSYDDSNHISVFGTGTKVTVLGQPKANP

SEQ ID NO: 4021 - protein, 107 aa, Artificial Sequence
  Synthetic Polypeptide
DIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIK

SEQ ID NO: 4022 - protein, 108 aa, Artificial Sequence
  Synthetic Polypeptide
DIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIKR

SEQ ID NO: 4023 - protein, 107 aa, Artificial Sequence; identical to SEQ ID NO: 4021
  Synthetic Polypeptide

SEQ ID NO: 4024 - protein, 107 aa, Artificial Sequence
  Synthetic Polypeptide
DIVMTQSQKSMSTSVGDRVSITCKASQDVITGVAWYQQKPGQSPKLLIYSASYRYTGVPDRFTGSGSGTDFTFTISNVQAEDLAVYYCQQHYSTPLTFGAGTKLELK

SEQ ID NO: 4025 - protein, 109 aa, Artificial Sequence
  Synthetic Polypeptide
DIQMTQSPSSLSASVGDRVTITCKASQDVSTAVAWYQQKPGKAPKLLIYSASYRYTGVPDRFTGSGSGTDFTLTISSLQPEDFATYYCQQHYSTPPYTFGGGTKVEIKR

SEQ ID NO: 4026 - protein, 113 aa, Artificial Sequence
  Synthetic Polypeptide
DVVMTQTPLSLSVTPGQPASISCRSSQSLVHNNGNTYLHWYLQKPGQSPQLLIYKVSNRFSGVPDRFSGSGSGTDFTLKISRVEAEDVGVYFCSQSTHVPPYTFGGGTKVEIK

SEQ ID NO: 4027 - protein, 113 aa, Artificial Sequence
  Synthetic Polypeptide
DVVMTQTPLSLSVTPGQPASISCRSSQSLVHSNGLTYLHWYLQKPGQSPQLLIYKVSNRFSGVPDRFSGSGSGTDFTLKISRVEAEDVGVYFCSQSTHVPPFTFGGGTKVEIK

SEQ ID NO: 4028 - protein, 113 aa, Artificial Sequence
  Synthetic Polypeptide
DVVMTQSPLSLPVTPGEPASISCRSSQSLVHSNGNTYLHWYLQKPGQSPQLLIYKVSNRFSGVPDRFSGSGSGTDFTLKISRVEAEDVGVYFCSQSTHVPPFTFGGGTKVEIK

SEQ ID NO: 4029 - protein, 107 aa, Artificial Sequence
  Synthetic Polypeptide
DIQMTQSSSYLSVSLGGRVTITCKASDHINNWLAWYQQKPGNAPRLLISGATSLETGVPSRFSGSGSGKDYTLSITSLQTEDVATYYCQQYWSTPWTFGGGTKLEIK

SEQ ID NO: 4030 - protein, 108 aa, Artificial Sequence
  Synthetic Polypeptide
DIVMTQSHKFMSTSVGDRVSITCKASQDVSTAVAWYQQKPGQSPKLLIYSASYRYTGVPDRFTGSGSGTDFTFTISSVQAEDLAVYYCQQHYSTPPYTFGGGTKLEIK

SEQ ID NO: 4031 - protein, 113 aa, Artificial Sequence
  Synthetic Polypeptide
QSVLTQPPSVSGAPGQRVTISCTGSGSNIGAPYDVSWYQQLPGTAPKLLIYHNNKRPSGVPDRFSGSKSGTSASLAITGLQAEDEADYYCQSYDSSSISTIFGGGTKLTVLGA

SEQ ID NO: 4032 - protein, 113 aa, Artificial Sequence
  Synthetic Polypeptide
QSVLTQPPSVSGAPGQRVTISCTGSGSNIGAPYDVSWYQQLPGTAPKLLIYHNNKRPSGVPDRFSGSKSGTSASLAITGLQAEDEADYYCATVEAGLSGSVFGGGTKLTVLGA

SEQ ID NO: 4033 - protein, 107 aa, Artificial Sequence
  Synthetic Polypeptide
DIQMTQSPSSLSASVGDRVTITCSASSSVSYMYWYQQKPGKAPKLLIYLTSNLASGVPSRFSGSGSGTDFTLTISSLQPEDFATYYCQQWRSNPFTFGQGTKLEIKR

SEQ ID NO: 4034 - protein, 108 aa, Artificial Sequence
  Synthetic Polypeptide
EIVMTQSPATLSVSPGERATLSCKASQSVSNDVVWYQQKPGQAPRLLIYYASNRYTGIPARFSGSGSGTEFTLTISSLQSEDFAVYYCQQDYTSPWTFGQGTKLEIKR

SEQ ID NO: 4035 - protein, 111 aa, Artificial Sequence
  Synthetic Polypeptide
STDIQMTQSPSSLSASVGDRVTITCRASQSISSYLNWYQQKPGKAPKLLIYLASNLQSGVPSRFSGSGSGTDFTLTISSLQPEDFATYYCQQAEYMPLTFGQGTKVEIKRA

SEQ ID NO: 4036 - protein, 107 aa, Artificial Sequence
  Synthetic Polypeptide
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 4037 - protein, 111 aa, Artificial Sequence
  Synthetic Polypeptide
DIQMTQSPSSLSASVGDRVTITCRSSQNIVHSNGNTYLDWYQQTPGKAPKLLIYKVSNRFSGVPSRFSGSGSGTDFTFTISSLQPEDIATYYCFQYSHVPWTFGQGTKLQI

SEQ ID NO: 4038 - protein, 105 aa, Artificial Sequence
  Synthetic Polypeptide
DIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVE

SEQ ID NO: 4039 - protein, 112 aa, Artificial Sequence
  Synthetic Polypeptide
DVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIK

SEQ ID NO: 4040 - protein, 107 aa, Artificial Sequence
  Synthetic Polypeptide
ELQMTQSPSSLSASVGDRVTITCRASQSISSYLNWYQQKPGQPPKLLIYWASTRESGVPDRFSGSESGTNYTLTISSLQPEDFATYFCQQSDSLPITFGQGTRLDIQ

SEQ ID NO: 4041 - protein, 113 aa, Artificial Sequence
  Synthetic Polypeptide
ELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIK

SEQ ID NO: 4042 - protein, 112 aa, Artificial Sequence
  Synthetic Polypeptide
DVVMTQTPLSLPVSLGDQASISCRSSQSLVHSNGNTYLRWYLQKPGQSPKVLIYKVSNRFSGVPDRFSGSGSGTDFTLKISRVEAEDLGVYFCSQSTHVPWTFGGGTKLEIK

SEQ ID NO: 4043 - protein, 112 aa, Artificial Sequence
  Synthetic Polypeptide
DVVMTQTPLSLPVSLGDQASISCRSSQSLVHSNGNTYLRWYLQKPGQSPKVLIYKVSNRVSGVPDRFSGSGSGTDFTLKINRVEAEDLGVYFCSQSTHVPWTFGGGTKLEIK

SEQ ID NO: 4044 - protein, 110 aa, Artificial Sequence [sequence omitted]

SEQ ID NO: 4045 - protein, 107 aa, Artificial Sequence
  Synthetic Polypeptide
DIQMTQSPSSLSASVGDRVTITCRASQSISSYLNWYQQKPGKAPKLLIYAASSLQSGVPSRFSGSGSGTDFTLTISSLQPEDLATYYCQQSYSTPFTFGPGTKVDIK

SEQ ID NO: 4046 - protein, 103 aa, Artificial Sequence
  Synthetic Polypeptide
YIHVTQSPSSLSVSIGDRVTINCQTSQGVGSDLHWYQHKPGRAPKLLIHHASSVEDGVPSRFSGTGFHTSFNLTINDLQADDIGTYYCQVLQSFGRGSRLDTK

SEQ ID NO: 4047 - protein, 112 aa, Artificial Sequence
  Synthetic Polypeptide
DIVLTQSPLSLAVSLGQPAIISCKASQSVSFAGTSLMHWYHQKPGQQPRLLIYRASNLEAGVPDRFSGSGSKTDFTLTISPVEAEDAATYYCQQSREYPYTFGGGTKLEIKR

SEQ ID NO: 4048 - protein, 109 aa, Artificial Sequence
  Synthetic Polypeptide
LETTLTQSPATLSVSPGERVTLSCRASQSVGSNLAWYQQKFGQAPRLLIYDASTRATGIPARFSGSGSGTEFTLTISRLEPEDFAVYYCHQYGSSPRTFGQGTKVDIKR

SEQ ID NO: 4049 - protein, 113 aa, Artificial Sequence
  Synthetic Polypeptide
DVVMTQTPLSLPVTPGEPASISCRSSQSLVHRNGNTYLHWYLQKPGQSPKLLIHKVSNRFSGVPDRFSGSGSGTDFTLKISRVEAEDLGVYFCSQSTHVPPLTFGAGTKLELK

SEQ ID NO: 4050 - protein, 105 aa, Artificial Sequence
  Synthetic Polypeptide
EIVMTQTPATLSVSAGERVTITCKASQSVSNDVTWYQQKPGQAPRLLIYSASNRYSGVPARFSGSGYGTEFTFTISSVQSEDFAVYFCQQDYSSFGQGTKLEIKR

SEQ ID NO: 4051 - protein, 108 aa, Artificial Sequence
  Synthetic Polypeptide
DIQMTQTASSLPASLGDRVTISCSASQDISNYLNWYQQKPDGTVKLLIFYSSNLHSGVPSRFSGGGSGTDYSLTISNLEPEDIATYFCHQYSKLPWTFGGGTKLEIKR

SEQ ID NO: 4052 - protein, 111 aa, Artificial Sequence
  Synthetic Polypeptide
QFVLTQSPSVSAALGASAKLTCTLSSAHKTYTIDWYQQQQGEAPRYLMQVKSDGSYTKGTGVPDRFSGSSSGADRYLIIPSVQADDEAGYVCGADDNGGYVFGGGTQLTVT

SEQ ID NO: 4053 - protein, 111 aa, Artificial Sequence; identical to SEQ ID NO: 4052
  Synthetic Polypeptide

SEQ ID NO: 4054 - protein, 111 aa, Artificial Sequence
  Synthetic Polypeptide
QFVLTQSPSASAALGASAKLTCTLSSAHKTYTIDWYQQQKGKAPRYLIQVKSDGTYTKATGVPDRFSGSSSGADRYLIIPSVQADDEADYYCGTDYTGGYVFGGGTQLTVT

SEQ ID NO: 4055 - protein, 107 aa, Artificial Sequence; identical to SEQ ID NO: 3988
  Synthetic Polypeptide

SEQ ID NO: 4056 - protein, 107 aa, Artificial Sequence; identical to SEQ ID NO: 3988
  Synthetic Polypeptide

SEQ ID NO: 4057 - protein, 112 aa, Artificial Sequence
  Synthetic Polypeptide
NFMLTQPHSVSESPGKTVTISCTGSGGSIDNNYVHWYQQRPGSAPTTVMFEDNQRPSGVPDRFSGSIDSSSNSASLVISGLKTEDEGDYYCQSSDGSKVVFGGGTKLTVLGQ

SEQ ID NO: 4058 - protein, 107 aa, Artificial Sequence
  Synthetic Polypeptide
NIELTQSPAIMSASPGERVTMTCSASSSIRYIYWYQQKPGSSPRLLIYDTSNVAPGVPFRFSGSGSGTSYSLTINRMEAEDAATYYCQEWSGYPYTFGGGTKLDIKR

SEQ ID NO: 4059 - protein, 112 aa, Artificial Sequence
  Synthetic Polypeptide
DVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQNTPVPPKFGSGTKLEIK

SEQ ID NO: 4060 - protein, 107 aa, Artificial Sequence
  Synthetic Polypeptide
DIQLTQSPSSLSASVGDRVTITCRASQGIRNDLGWYQQKPGKAPKRLIYAASSLQNGVPSRFSGSGSGTEFTLTISSLQPEDFATYYCLQHNTYPAFGQGTKVEIKR

SEQ ID NO: 4061 - protein, 111 aa, Artificial Sequence
  Synthetic Polypeptide
QSVVTQPPSMSAAPGQQVTISCSGGNSNIERNYVSWYLQLPGTAPKLVIFDNDRRPSGIPDRFSGSKSGTSATLGITGLQTGDEADYYCGTWDSSLRGWVFGGGTKLTVLG

SEQ ID NO: 4062 - protein, 111 aa, Artificial Sequence
  Synthetic Polypeptide
QSVLTQPPSASGTPGQRVTISCSGSRSNVGGNYVFWYQQVPGATPKLLIYRSNQRPSGVPDRFAGSKSGSSASLAISGLRSEDEADYYCATWDDSLSGFVFGTGTKVTVLG

SEQ ID NO: 4063 - protein, 113 aa, Artificial Sequence
  Synthetic Polypeptide
QSVVTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSYVFGTGTKLTVLG

SEQ ID NO: 4064 - protein, 111 aa, Artificial Sequence
  Synthetic Polypeptide
QSVVTQPASVSGSPGQSITISCTGTSSDVGGYNYVSWYQQHPGKAPKLMIYDVSKRPSGVSNRFSGSKSGNTASLTISGLQAEDEADYYCSSYTSSSTLVFGGGTKLTVLG

SEQ ID NO: 4065 - protein, 107 aa, Artificial Sequence
  Synthetic Polypeptide
DIQMTQSPSSLSASVGDRVTITCRASQDVNTAVAWYQQKPGKAPKLLIYSASFLESGVPSRFSGSRSGTDFTLTISSLQPEDFATYYCQQHYTTPPTFGQTKVEIKR

SEQ ID NO: 4066 - protein, 105 aa, Artificial Sequence
  Synthetic Polypeptide
DIQMTQSPSSLSASVGDTVTITCQANGYLNWYQQRRGKAPKLLIYDGSKLERGVPSRFSGRRWGQEYNLTINNLQPEDIATYFCQVYEFVVPGTRLDLKRTVAAP

SEQ ID NO: 4067 - protein, 107 aa, Artificial Sequence
  Synthetic Polypeptide
QSVLTQPPSVSVAPGKTARIPCEGNYIGSSNVHWYQQKPGQAPVLVIHFDSDRPSGIPDRFSGSNSGNMATLTISRVEAGDEADYYCQVWENHGWVFGGGTKLTVLS

SEQ ID NO: 4068 - protein, 105 aa, Artificial Sequence
  Synthetic Polypeptide
QSALTQPPSASGSPGQSITISCTGTSNNFVSWYQQHAGKAPKLVIYDVNKRPSGVPDRFSGSKSGNTASLTVSGLQTDDEAVYYCGSLVGNWDVIFGGGTKLTVL

SEQ ID NO: 4069 - protein, 104 aa, Artificial Sequence
  Synthetic Polypeptide
EIVLTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIKR

SEQ ID NO: 4070 - protein, 107 aa, Artificial Sequence
  Synthetic Polypeptide
ELVLTQSPGTLSLSAGERATLSCRASQSVSSGSLAWYQQKPGQAPRLLIYGASTRATGIPDRFSGSGSGTDFTLTIGRLEPEDLAVYYCQQYGTSPYTFGQGTKLEI

SEQ ID NO: 4071 - protein, 108 aa, Artificial Sequence
  Synthetic Polypeptide
DVVMTQSPSSLSASVGDRVTITCQSSLDISHYLNWYQQKPGKAPKLLIYDASNLETGVPSRFSGSGSGTHFTFTISSLQPEDFATYYCQQYDNLPLTFGGGTKLEIKR

SEQ ID NO: 4072 - protein, 108 aa, Artificial Sequence
  Synthetic Polypeptide
DIVMTQSQDSMATSVGERVTVNCKASQNVDTNVAWYQQKPGQSPEPLLFSASYRYTGVPDRFSGSGSGTDFTLTISSVQAEDVAEYFCQQYNSYPLTFGQGTKLEIKR

SEQ ID NO: 4073 - protein, 113 aa, Artificial Sequence
  Synthetic Polypeptide
SYELTQPPSVSGTPGQRVAISCSGSSSNIGTRMVTWYQHVPGTAPKLLIFNNNQRPSGVPDRFSASKSGTSASLAIIGLQSDDEADYYCATWDDNVKSYVFGTGTKVTVLGSR

SEQ ID NO: 4074 - protein, 110 aa, Artificial Sequence
  Synthetic Polypeptide
QSVLTQPPSLSVAPGKTASITCGGNNIGMKSVHWYQQRPGQAPVLVIYYDSDRPSGIPGRFSGSNSGNTATLTISRVEAGDEADYYCQVWDTTGDHPGYVFGTGTKVTVL

SEQ ID NO: 4075 - protein, 109 aa, Artificial Sequence
  Synthetic Polypeptide
EIVLTQSPATLSLSPGERATLSCRASQSVGSYLAWYQQKPGAPRLLIYDASHRATGIPARFSGSGSGTDFTLTISSLEPEDFAVYYCQQRSNWPPMYTFGQGTKLEIKR

SEQ ID NO: 4076 - protein, 113 aa, Artificial Sequence
  Synthetic Polypeptide
EIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPRTFGQGTKVEIKR

SEQ ID NO: 4077 - protein, 97 aa, Artificial Sequence
  Synthetic Polypeptide
DIQMTQSPSSLSASVGDRVTITCQASQDINNYLNWYQQKPGKAPKLLIYDASNLQTGVPSRFSGSGSGTDFTFTIEDIATYYCQQYTFGPGTKVDIK

SEQ ID NO: 4078 - protein, 109 aa, Artificial Sequence
  Synthetic Polypeptide
DIQMTQSPSSLSASVGDRVTITCTASLSVSSTYLHWYQQKPGSSPKLWIYSTSNLASGVPSRFSGSGSGTSYTLTISSLQPEDFATYYCHQYHRSPLTFGGGTKVEIKR

SEQ ID NO: 4079 - protein, 107 aa, Artificial Sequence
  Synthetic Polypeptide
DIQMTQSPSSLSASVGDRVTITCKASQDVGTAVAWYQQKPGKAPKLLIYSASYRSTGVPSRFSGSGSGTDFTLTISSLQPEDFATYYCQHHYSAPWTFGGGTKVEIK

SEQ ID NO: 4080 - protein, 119 aa, Artificial Sequence
  Synthetic Polypeptide
QVQLQESGPGLVKPSETLSLTCAVSGYSISDDHAVSWVRQPPGEGLEWIGFISYSGITNYNPTLQDRVTISRDNSKNTLYLQMNSLRAEDTAVYYCARLLARATAMDVWGEGTLVTVSS

SEQ ID NO: 4081 - protein, 103 aa, Artificial Sequence
  Synthetic Polypeptide
DIQMTQSPSSLSASVGDRVTITCRTSQSLSSYTHWYQQKPGKAPKLLIYAASSRGSGVPSRFSGSGSGTDFTLTISSLQPEDFATYYCQQSRTFGQGTKVEIK

SEQ ID NO: 4082 - protein, 106 aa, Artificial Sequence
  Synthetic Polypeptide
IQMTQSSSYLSVSLGGRVTITCKASAHINNWLAWYQQKPGNAPRLLISGATSLETGVPSRFSGSGSGKDYTLSINSLQTEDVATYYCQQYWSLPRTFGGGTRLEIK

SEQ ID NO: 4083 - protein, 113 aa, Artificial Sequence
  Synthetic Polypeptide
DIVMTQSPSSLTMSVGQKVTMSCKSSHSLLNSRNQKNYLAWFQQKPGQSPKLLVYFASTRESGVPDRFIGSGSGTDFTLTISNVQAEDLADYFCQQHYTTLPTFGGGTKLEIK

SEQ ID NO: 4084 - protein, 108 aa, Artificial Sequence
  Synthetic Polypeptide
DIQMTQSFSSLSASVGDRVTITCRASQDISNYLNWYQQKPGKAPKLLIYYTSRLHSGVPSRFSGSGSGTDYTLTISSLQPEDFATYFCQQGNTLPWTFGGGTKLEIKR

SEQ ID NO: 4085 - protein, 107 aa, Artificial Sequence
  Synthetic Polypeptide
DIQMTQSPPSLSASVGGKVTITCKASQDIDRYMAWYQDKPGKGPKLLIHDTSTLQPGIPSRFSGSGSGRDYSFSISNLEPEDIATYYCLQYDNLWTFGGGTKLEIKR

SEQ ID NO: 4086 - protein, 107 aa, Artificial Sequence
  Synthetic Polypeptide
DIQMTQSPASLSASVGETVTITCRVSGNIHNYLAWYQQKQGKSPQLLVYNAKTLADGVPSRFSGSGSGTQYSLKINSLQPEDFGSYYCQHFWSNPYTFGGGTKLEIK

SEQ ID NO: 4087 - protein, 112 aa, Artificial Sequence
  Synthetic Polypeptide
DIQMTQSPSSLSASVGDRVTITCRSSQRIVHSNGNTYLEWYQQTPGKAPKLLIYKVSNRFSGVPSRFSGSGSGTDYTPTISSLQPEDIATYYCFQGSHVPPTFGQGTKLQIT

SEQ ID NO: 4088 - protein, 107 aa, Artificial Sequence
  Synthetic Polypeptide
DIQMTQSPASLSASVGETVTIICRASVNIYSYLAWYQQKQGKSPQLLVYNAKILAEGVPSRFSGSGSGTQFSLKINSLQPEDFGSYYCQHHYGTFTFGSGTKLEIKR

SEQ ID NO: 4089 - protein, 107 aa, Artificial Sequence
  Synthetic Polypeptide
DIVMTQSHKFMSTSVGDRVSVTCKASQNVGNNVAWYQQKPGQSPKVLIYSASYRYSGVPDRFTGSGSGTDFTLTISNVQSEDLAEYFCQQYNTYPFTFGSGTKLEIK

SEQ ID NO: 4090 - protein, 116 aa, Artificial Sequence
  Synthetic Polypeptide
DQSVLTQPPSVSGAPGQRVTISCTGSSSNIGAGYDVHWYQQLPGTAPKLLIYGNSNRPSGVPDRFSGSKSGTSASLAITGLQAEDEADYYCQSYDNSLSSWVFGGGTKLTVLGQPK

SEQ ID NO: 4091 - protein, 115 aa, Artificial Sequence
  Synthetic Polypeptide
DQSVVTQPPSVSAAPGRKVTISCSGSSSNIGSNYVSWYQQVPGTAPKLLIYEDDKRPSGIPDRFSGSKSGTSATLGITGLQTGDEADYFCATWDRTVNVVRFGGGTRLTVHSQPK

SEQ ID NO: 4092 - protein, 108 aa, Artificial Sequence
  Synthetic Polypeptide
DIQMTQSPSSLSASVGDRVTITCRASQSISSYLNWYQQKPGKAPKLLIYAASSLQSGVPSGFSGSGSGTDFTLTISSLQPEDFATYYCQQSYSTPLTFGGGTKVEIKR

SEQ ID NO: 4093 - protein, 108 aa, Artificial Sequence
  Synthetic Polypeptide
DIQMTQSSSSFSVSLGDRVTITCKASEDIYIRLAWYQQKPGNAPRLLISAATSLETGIPSRFSGSGSGEDYTLTITSLQTEDVATYYCQQYWTTPWTFGGGTKLEIKR

SEQ ID NO: 4094 - protein, 107 aa, Artificial Sequence
  Synthetic Polypeptide
DIQMTQSSSSFSVSLGDRVTITCMASEDIYIRLAWYQQKPGNAPRLLISAATSLETGVPSRFSGSGSGKDYTLSITSLQTEDVGTYYCQQYWSSPWTFGGGTKLEIN

SEQ ID NO: 4095 - protein, 107 aa, Artificial Sequence; identical to SEQ ID NO: 4094
  Synthetic Polypeptide

SEQ ID NO: 4096 - protein, 106 aa, Artificial Sequence
  Synthetic Polypeptide
QIVLTQSPAIMSASPGEKVTISCSASSSVSYMYWYQQKPGSSPKPWIYRTSNLASGVPARFSGSGSGTSYSLTISNMEAEDAAAYYCQQYHSYPTTFGGGTKLEVK

SEQ ID NO: 4097 - protein, 112 aa, Artificial Sequence
  Synthetic Polypeptide
DIVMTQAAPSIPVTPGESVSISCRSDKSLLHSNGNTYLFWFLQRPGQSPQLLIYRMSNLASGVPDRFSGSGSGTAFTLRISGVEAEDVGVYYCMQHLEYPYTFGGGTKLEIK

SEQ ID NO: 4098 - protein, 112 aa, Artificial Sequence
  Synthetic Polypeptide
DIVMTQSPLSLPVTPGEPASISCRSSKSLLHSNGNTYLYWFQQKPGQAPRLLIYRMSNLASGVPDRFSGSGSGTAFTLKISRVEAEDVGVYYCMQHIEYPFTFGQGTKLEIK

SEQ ID NO: 4099 - protein, 115 aa, Artificial Sequence
  Synthetic Polypeptide
SSYVLTQPPSVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLGAAA

SEQ ID NO: 4100 - protein, 111 aa, Artificial Sequence
  Synthetic Polypeptide
DIVLTQSPASLAVSLGQSVTISCRASESVEYYGTSLMQWYQQKPGQPPKLLIYGASNVESGVPARFSGSGSGTDFSLNIHPVEEDDIAMYFCQQSRKVPWTFGGGTKLEIK

SEQ ID NO: 4101 - protein, 109 aa, Artificial Sequence
  Synthetic Polypeptide
ETTLTQSPGTLSLSPGERATLSCRASQSVSSSYLAWYQQKPGQAPRLLIYGASSRATGIPDRFSGSGSGTDFTLTISRLEPEDFAVYYCQQYGSSPRTFGQGTKVEIKR

SEQ ID NO: 4102 - protein, 108 aa, Artificial Sequence
  Synthetic Polypeptide
EIVMTQSPATLSLSPGERATLSCRASQSVSSYLAWYQQKPGQAPRLLIYDASNRATGIPARFSGSGSGTDFTLTISSLEPEDFAVYYCHQYGSSPQTFGQGTKVEIKR

SEQ ID NO: 4103 - protein, 113 aa, Artificial Sequence
  Synthetic Polypeptide
DIELTQSPSSLAVSAGEKVTMSCKSSQSLLNSRTRKNQLAWYQQKPGQSPELLIYWASTRQSGVPDRFTGSGSGTDFTLTISSVQAEDLAVYYCQQSYNLLTFGPGTKLEVKR

SEQ ID NO: 4104 - protein, 109 aa, Artificial Sequence
  Synthetic Polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIKR

SEQ ID NO: 4105 - protein, 112 aa, Artificial Sequence
  Synthetic Polypeptide
DVVMTQTPLTLSVTIGQPASISCKSSQSLLDSDGKTYLHWLLQRPGQSPKRLIFLVSKLDSGVPDRFTGSGSGTDFTLKISRVEAEDLGVYYCWQGTHFPQTFGGGTKLEIK

SEQ ID NO: 4106 - protein, 110 aa, Artificial Sequence
  Synthetic Polypeptide
DQSELTQPRSVSGSPGQSVTISCTGTERDVGGYNYVSWYQQHPGKAPKLIIHDVIERSSGVPDRFSGSKSGNTASLTISGLQAEDEADYYCWSFAGGYYVFGTGTDVTVL

SEQ ID NO: 4107 - protein, 97 aa, Artificial Sequence
  Synthetic Polypeptide
EIVLTQSPATLSLSPGERATLSCRASQSVSSYLAWYQQKPGQAPRLLIYDASNRATGIPARFSGSGSGTDFTLTIEDFAVYYCQQSTFGQGTKVEIK

SEQ ID NO: 4108 - protein, 107 aa, Artificial Sequence [sequence omitted]

SEQ ID NO: 4109 - protein, 107 aa, Artificial Sequence
  Synthetic Polypeptide
DIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIK

SEQ ID NO: 4110 - protein, 108 aa, Artificial Sequence
  Synthetic Polypeptide
DIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKR

SEQ ID NO: 4111 - protein, 112 aa, Artificial Sequence
  Synthetic Polypeptide
AIVMTQTPSPVSAAVGGTVTINCQASESVYSNNYLSWFQQKPGQPPKLLIYLASTLASGVPSRFKGSGSGTQFTLTISGVQCDDAATYYCIGGKSSSTDGNAFGGGTEVVVR

SEQ ID NO: 4112 - protein, 108 aa, Artificial Sequence
  Synthetic Polypeptide
DIVVTQSPASLAVSLGQRATISYRASKSVSTSGYSYMHWNQQKPGQPPRLLIYLVSNLESGVPARFSGSGSGTDFTLNIHPVEEEDAATYYCQHIRELTRSEGGPSWK

SEQ ID NO: 4113 - protein, 106 aa, Artificial Sequence
  Synthetic Polypeptide
QLTQSPSSVSASVGDRVTITCRASRGISSWLAWYQQKPGKAPKLLIYTASSLQSGVPSRFSGSGSGTDFTLTISSLQPEDFATYYCQQAYSFPRTFGQGTKVEIKR

SEQ ID NO: 4114 - protein, 113 aa, Artificial Sequence
  Synthetic Polypeptide
DIVMTQSPLSLPVTPGEPASISCRSSQSLLHSNGYNYLVWYLQKPGQSPQLLIYLGSIRASGVPDRFSGSGSGTDFTLKISRVEAEDVGVYYCMQPLQTPITFGQGTRLEIKR

SEQ ID NO: 4115 - protein, 107 aa, Artificial Sequence
  Synthetic Polypeptide
DIQMTQSPSSLSASVGDRVTITCRASQGISNYLAWYQQKTGKVPKFLIYEASTLQSGVPSRFSGGGSGTDFTLTISSLQPEDVATYYCQNYNSAPFTFGPGTKVDIK

SEQ ID NO: 4116 - protein, 107 aa, Artificial Sequence
  Synthetic Polypeptide
DIQMTQSPSSLSTSVGDRVTLTCKASQDVGTAVDWYQQKPGPSPKLLIYWASTRHTGIPSRFSGSGSGTDFTLTISSLQPEDFADYYCQQYNSYPLTFGPGTKVDIK

SEQ ID NO: 4117 - protein, 103 aa, Artificial Sequence
  Synthetic Polypeptide
DIQMTQSPSSLSASVGDRVTITCKASQDIYPYLNWFQQKPGKAPKTLIYRTNRLLDGVPSRFSGSGSGTDFTFTISSLQPYYCLQYDEFPLTFGAGTKLEIKR

SEQ ID NO: 4118 - protein, 108 aa, Artificial Sequence
  Synthetic Polypeptide
DIVMTQSQKFMSTSVGDRVNVTCKASQNVGTNVVWYQQKTGQSPKALIHSASYRYSGVPDRFTGSGSGTDFTLTLSNVQSEDLAEYFCQHYNSFPYTFGGGTKLEIKR

SEQ ID NO: 4119 - protein, 107 aa, Artificial Sequence
  Synthetic Polypeptide
DIKMTQSPSSMYASLGERVTITCKASPDINSYLSWFQQKPGKSPKTLIYRANRLVDGVPSRFSGGGSGQDYSLTINSLEYEDMGIYYCLQYDEFPYTFGGGTKLEMK

SEQ ID NO: 4120 - protein, 108 aa, Artificial Sequence
  Synthetic Polypeptide
DVVVTPVSCFLSCISGAEGHHLIQGQQKCQYIWLLYALEPTETRTATQTPHLSCIQPRIWGPCQVQWQWVWDRLHPQHPSCGGGGCCNLLLSAHGAYTFGGGTRLELK

SEQ ID NO: 4121 - protein, 107 aa, Artificial Sequence
  Synthetic Polypeptide
QSVLTQPPSASAGGTPGQRVTISCSGSSSNIGSNFVYWYQQLPGTAPKLLIYRNNQRPSGVPDRFSGSRSGTSASLAGLRSEDEADYYCAADSLGGHYVFGTGTKVL

SEQ ID NO: 4122 - protein, 108 aa, Artificial Sequence
  Synthetic Polypeptide
EIVMTQSPATLSVSPGERATLSCRASQSVSSNLAWYQQKPGQAPRLLIYGASTRATGIPARFSGSGSGTDFTLTISSLQSVDSAVYYCQQYNNWPPYTFGQGTKLEIK

SEQ ID NO: 4123 - protein, 106 aa, Artificial Sequence
  Synthetic Polypeptide
ENVLTQSPAIMSASPGEKVTMTCSASSSVSYMHWYQQKSSTSPKLWIYDTSKLASGVPGRFSGSGSGNSYSLTISSMEAEDVATYYCFQGSGYPLTFGAGTKLELK

SEQ ID NO: 4124 - protein, 108 aa, Artificial Sequence
  Synthetic Polypeptide
DIQMTQSPSSLSASVGDRVTITCRASQSISSYLNWYQQKPGKAPKLLIYDASNLETGVPSRFSGSGSGTDFTFTISSLQPEDIATYYCQQYDNLPLTFGGGTKVDIKR

SEQ ID NO: 4125 - protein, 113 aa, Artificial Sequence
  Synthetic Polypeptide
DVVMTQSPLSLPVSLGDQASISCRSSQRLVHSNGNTYLHWYLQKPGQSPKLLIYRVSNRFPGVPDRFSGSGSGTDFTLKISRVEAEDLGIYFCSQSTHVPYTFGGGTKLEIKR

SEQ ID NO: 4126 - protein, 109 aa, Artificial Sequence
  Synthetic Polypeptide
SYELTQPPSVSVSPGQTATISCSGDQLGGKYGHWYQKKPGQSPVLVLYQDRKRPAGIPERFSGSSSGNTITLTISGTQAVDEADYYCQAWDTNLGGVFGGGTKVTVLGQ

SEQ ID NO: 4127 - protein, 113 aa, Artificial Sequence
  Synthetic Polypeptide
NFMLTQPHSVSESPGKTVTISCTRSSGSIASKYVQWYQQRPGSSPTTVIYEDNQRPSGVPDRFSGSIDTSSNSASLTISGLRTEDEADYYCHSYDSNNHSVFGGGTKVTVLGQ

SEQ ID NO: 4128 - protein, 108 aa, Artificial Sequence
  Synthetic Polypeptide
DIQMNQSPSSLSASLGDTITITCHASQNINVWLSWYQQKPGNIPKLLIYKASNLHTGVPSRFSGSGSGTGFTITISSLQPEDIATYYCQQGQSYPWTFGGGTKLEIKR

SEQ ID NO: 4129 - protein, 109 aa, Artificial Sequence
  Synthetic Polypeptide
ETTLTQSPGTLSLSPGERATLSCRASQSVSSSYLAWYQQKPGQAPRLLIYGASSRATGIPDRFSGSGSGTDFTLTISRLEPEDFAVYYCQQYGSSPYTFGQGTKLEIKR

SEQ ID NO: 4130 - protein, 108 aa, Artificial Sequence
  Synthetic Polypeptide
DIQMTQSPSILSASVGDRVTITCRASQRFGDYLAWYQQKPGQAPKLLIYGASTLQSGVPSRFSGSGSGTEFTLTISGLQPEDFATYYCQQANSFPITFGKGTRLDIRR

SEQ ID NO: 4131 - protein, 107 aa, Artificial Sequence; identical to SEQ ID NO: 4109
  Synthetic Polypeptide

SEQ ID NO: 4132 - protein, 107 aa, Artificial Sequence
  Synthetic Polypeptide
EIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIK

SEQ ID NO: 4133 - protein, 114 aa, Artificial Sequence
  Synthetic Polypeptide
DIVMTQTPLSLPVTPGEPASISCRSSRSLLDSDDGNTYLDWYLQKPGQSPQLLIYTLSYRASGVPDRFSGSGSGTDFTLKISRVEAEDVGVYYCMQRVEFPITFGQGTRLEIKR

SEQ ID NO: 4134 - protein, 107 aa, Artificial Sequence
  Synthetic Polypeptide
EIQMTQSPSSMSASLGDTITITCQATQDIFKNLNWYQQKPGKPPSLLIYYATELAEGVPSRFSGSGSGSDYSLTISNLESEDFAAYYCLQFFEFPFTFGSGTKLEMK

SEQ ID NO: 4135 - protein, 108 aa, Artificial Sequence
  Synthetic Polypeptide
DILLTQSPAILSVSPGERVSFSCRASQNIGTSIHWYQQRTNGSPRLLIKYASESVSGIPSRFSGSGSGTDFTLSINSVESEDIADYYCQHTNSWPTTFGGGTKLEIKR

SEQ ID NO: 4136 - protein, 113 aa, Artificial Sequence
  Synthetic Polypeptide
DIVMTQSPDSLAVSLGERATINCKSSQSLLNSGDQKNYLTWYQQKPGQPPKLLIYWASTRESGVPDRFSGSGSGTDFTLTISSLQAEDVAVYYCQNDYSYPLTFGQGTKVEIK

SEQ ID NO: 4137 - protein, 107 aa, Artificial Sequence
  Synthetic Polypeptide
DIQMTQSPSSLSASVGDRVTITCKASQDVSIAVAWYQQKPGKAPKVLIYSASYRYTGVPDRFSGSGSGTDFTFTISSLQPEDIAVYYCQQHYITPLTFGGGTKVEIK

SEQ ID NO: 4138 - protein, 111 aa, Artificial Sequence
  Synthetic Polypeptide
DIVMTQSPDSLAVSLGERATINCRASKSVSTSGYSYMHWYQQKPGQPPKLLIYLASNLESGVPDRFSGSGSGTDFTLTISSLQAEDVAVYYCQHSRELPYTFGQGTKLEIK

SEQ ID NO: 4139 - protein, 109 aa, Artificial Sequence
  Synthetic Polypeptide
AIQMTQSPSSLSASVGDRVTITCRASQSISNYLNWYQQKPGKAPKLLIYAASSLQSGVPSRFSGSGSGTDFTLTISSLQPEDFATYYCQQSYSSPSTTFGQGTKLEIKR

SEQ ID NO: 4140 - protein, 107 aa, Artificial Sequence
  Synthetic Polypeptide
QSVLTQPPSVSVSPGQTASITCSGDKLGDKYACWYQQKPGQSPVLVIYQDSKRPSGIPERFSGSNSGNTATLTISGTQAMDEADYYCQAWDSSTAVVFGGGTKLTVL

SEQ ID NO: 4141 - protein, 107 aa, Artificial Sequence
  Synthetic Polypeptide
DIVMTQSQKFMSTSVGDRVSIICKASQNVGTFVAWYQQKPGQSPKLLVYSASNRYTGVPDRFTGSGSGTDFTLTINNMQSEDLADYFCRQYSSYPYTFGGGTKLEIK

SEQ ID NO: 4142 - protein, 108 aa, Artificial Sequence
  Synthetic Polypeptide
DIQMTQSPSSLSASVGDRVTITCRASQSIGTSLHWYQQKPGKAPKLLIKFASRLQSGVPSRFSGSGSGTDFTLTISSLQPEDFATYYCQQSPGFPPTFGQGTKLEIKR

SEQ ID NO: 4143 - protein, 113 aa, Artificial Sequence
  Synthetic Polypeptide
EIVLTQSPLSLPVTPGEPASISCRSSQSLLHSIGYNYLDWYLQKPGQSPQLLIYLGSNRASGVPDRFSGSGSGTDFTLKISRVEAEDVGVYYCMQALQTPLTFGGGTKVEIKR

SEQ ID NO: 4144 - protein, 113 aa, Artificial Sequence
  Synthetic Polypeptide
DVVMTQSPLSLPVTPGEPASISCRSSQSLLHSIGYNYLHWFLQKPGQSPQLLIYLGSNRASGVPDRFSGSGSGTDFTLKISRVEAEDVGVYYCMQALQTPPTFGQGTRLEIKR

SEQ ID NO: 4145 - protein, 113 aa, Artificial Sequence
  Synthetic Polypeptide
DVVMTQSPLSLPVTPGEPASISCRSSQSLLHSNGHNYLDWYLQKPGQSPQLLIYLGSNRASGVPDRFSGSGSGTDFTLKISRVEAEDVGVYYCMQTLQTPLTFGPGTKVDIKR

SEQ ID NO: 4146 - protein, 107 aa, Artificial Sequence
  Synthetic Polypeptide
EIVLTQSPGTLSLSLGERATLSCRASQSISSSFLAWYQQKPGQAPKLLIYAASTRATGIPDRFSGSGSGTDFTLTISRLEPEDFAVYYCQQYGRSLSFGGGTKVEVK

SEQ ID NO: 4147 - protein, 110 aa, Artificial Sequence
  Synthetic Polypeptide
QAVVTQPPSASGTPGQRVTISCSGSSSNIGSNTVNWYQQVPGTAPKLLIYSNNQRPSGVPDRFSGSKSGTSASLAISGLQSEDEADYYCAAWDDSLNGWVFGGGTKLTVL

SEQ ID NO: 4148 - protein, 107 aa, Artificial Sequence
  Synthetic Polypeptide
DIQMTQSPSTLSASVGDRVTITCRASQNINKWLAWYQQRPGKAPQLLIYKASSLESGVPSRFSGSGSGTEYTLTISSLQPDDFATYYCQQYNSYATFGQGTKVEIKR

SEQ ID NO: 4149 - protein, 111 aa, Artificial Sequence
  Synthetic Polypeptide
QTVVTQPPSASGTPGQRVTISCSGSSSNIGSNYVYWYQQLPGTAPKLLIYRSNQRPSGVPDRFSGSKSGTSASLAISGPRSVDEADYYCAAWDDSLNGVVFGGGTKLTVLG

SEQ ID NO: 4150 - protein, 109 aa, Artificial Sequence
  Synthetic Polypeptide
QSVVTQPPSVSVAPGKTARITCGRNNIGSKSVHWYQQKPGQAPVLVVYDDSDRPSGIPERFSGSNSGNTATLTISRVEAGDEADYYCQVWDSSSDHVVFGGGTKLTVLG

SEQ ID NO: 4151 - protein, 109 aa, Artificial Sequence
  Synthetic Polypeptide
QAVLTQESALTTSPGETVTLTCRSSTGAVTTSNYANWVQEKPDHLFTGLIGGTNNRVPGVPARFSGSLIGDKAALTITGAQTEDEAIYFCVLWHSNHWVFGGGTKLTVL

SEQ ID NO: 4152 - protein, 108 aa, Artificial Sequence
  Synthetic Polypeptide
EIVLTQSPGTLSLSPGERATLSCRASQSVSNTYLAWYHQRPGQAPRLLIYGASSRATGIPDRFSGSGSGTDFALTISSLEPEDFAVYYCQQYSNSWTFGQGTKVEIKR

SEQ ID NO: 4153 - protein, 108 aa, Artificial Sequence
  Synthetic Polypeptide
ELTQDPAVSVALGQTVRITCQGDSLRSNYANWYQQKPGQAPVLVIYGQNNRPSGIPDRFSGSSSGNTASLTITGAQAADEADYYCDSRVSTGNHVVFGGGTKLTVLGQ

SEQ ID NO: 4154 - protein, 107 aa, Artificial Sequence
  Synthetic Polypeptide
DIVLTQTPATLSVTPGDSVSLSCRASQSISNNLHWYQQKSHESPRLLIKNASQSISGIPSKFSGSGSGTDFTLRINSVETEDFGMYFCQQSNSWPYTFGSGTKLEIK

SEQ ID NO: 4155 - protein, 106 aa, Artificial Sequence
  Synthetic Polypeptide
DIVMTQTPAIMSASPGQKVTITCSASSSVNYMHWYQQKLGSSPKLWIYDTSKLAPGVPARFSGSGSGTSYSLTISSMEAEDAASYFCHQWSSYPYTFGSGTKLEIK

SEQ ID NO: 4156 - protein, 106 aa, Artificial Sequence
  Synthetic Polypeptide
DIQMTQSPSSLSASVGDRVTITCSATSSISYMHWYQQKPGKAPKGWIYDTSKLAHGVPSRFSGSGSGTDFTLTISSLQPEDFATYYCHQRRSYPFTFGQGTKVEIK

SEQ ID NO: 4157 - protein, 108 aa, Artificial Sequence
  Synthetic Polypeptide
DIQMTQSPSSLSASVGDRVTITCKASQGFNKYVAWYQQKPGKAPKLLIYYTSTLQPGVPSRFSGSGSGRDYTLTISSLQPEDFATYYCLQYGNLLYAFGQGTKVEIKR

SEQ ID NO: 4158 - protein, 112 aa, Artificial Sequence
  Synthetic Polypeptide
DIQLTQSPSSLSASVGDRVTITCRASQSVDYDGDSYMNWYQQKPGKAPKLLIYAASYLESGVPSRFSGSGSGTDFTLTISSLQPEDFATYYCQQSHEDPYTFGQGTKVEIKR

SEQ ID NO: 4159 - protein, 107 aa, Artificial Sequence
  Synthetic Polypeptide
DIQMTQSPSSLSASVGDRVTITCRASQDIRYYLNWYQQKPGKAPKLLIYVASSLQSGVPSRFSGSGSGTEFTLTVSSLQPEDFATYYCLQVYSTPRTFGQGTKVEIK

SEQ ID NO: 4160 - protein, 107 aa, Artificial Sequence
  Synthetic Polypeptide
EIVMTQSPATLSVSPGERATLSCRASQSVSRNLAWYQQKPGQAPRLLIYGASTRATGIPARFSGSGSGTEFTLTIGSLQSEDFAVYYCQQYKTWPRTFGQGTNVEIK

SEQ ID NO: 4161 - protein, 107 aa, Artificial Sequence
  Synthetic Polypeptide
EIVMTPSSATLSVSPGERATLSCRASQSVSRNLAWYQQKPGQAPRLLIYGASTRATGIPARFSGSGSGTEFTLTISSLQSEDFAVYYCHQYSNWMCSFGQGTKLEIK

SEQ ID NO: 4162 - protein, 108 aa, Artificial Sequence
  Synthetic Polypeptide
DIQMTQSPSSLSASVGDRVTITCKASKNIRSYLAWYQQKPGKAPKLLIYSGSTLHSGVPSRFSGSGSGTDFTLTISSLQPEDFATYYCQQHHEYPLTFGQGTKVEIKR

SEQ ID NO: 4163 - protein, 113 aa, Artificial Sequence
  Synthetic Polypeptide
ELVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELK

SEQ ID NO: 4164 - protein, 124 aa, Artificial Sequence
  Synthetic Polypeptide
DVMLTQTPLSLPVSLGDQASISCRSSQSILHSTGDTYLEWYLQKPGQSPKLLINKVSNRLSGVPDRFSGSGSGTDFTLKISRVEAEDLGVYYCFQGSHVPWTFGGGTKLEIKRADAAPTVSIFP

SEQ ID NO: 4165 - protein, 108 aa, Artificial Sequence
  Synthetic Polypeptide
EIVLTQSPATLSLSPGERATLSCRASQSVSIYLAWYQQKPGQAPRLLIYDASNRATGIPARFSGSGSGTDFTLTISSLEPEDFAVYYCQQRSNWPPFTFGPGTKVDIK

SEQ ID NO: 4166 - protein, 107 aa, Artificial Sequence; identical to SEQ ID NO: 4109
  Synthetic Polypeptide

SEQ ID NO: 4167 - protein, 108 aa, Artificial Sequence
  Synthetic Polypeptide
LPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVL

SEQ ID NO: 4168 - protein, 111 aa, Artificial Sequence
  Synthetic Polypeptide
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSVFGTGTKVLVL

SEQ ID NO: 4169 - protein, 112 aa, Artificial Sequence
  Synthetic Polypeptide
NFMLTQPHSVSESPGKTVTISCTGSSGSIASNYVQWYQQRPGSAPTILIYEDNKRPSGVPDRFSGSIDSSSNSASLTISGLKTGDEADYYCQSYDDINHWVFGGGTKLTVLG

SEQ ID NO: 4170 - protein, 106 aa, Artificial Sequence
  Synthetic Polypeptide
QIVLTQSPAIMSASPGEKVTITCSASSSVSYMHWFQQKPGTSPKLWIYSTSNLASGVPARFSGSGSGTSYSLTISRMEAEDAATYYCQQRSSYPPTFGGGTKLEIK

SEQ ID NO: 4171 - protein, 113 aa, Artificial Sequence
  Synthetic Polypeptide
DIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPFTFGSGTKLEIK

SEQ ID NO: 4172 - protein, 107 aa, Artificial Sequence
  Synthetic Polypeptide
DTQMTQSPSSVSASVGDRVTITCRTSQDISNYLNWYQQKPGKAPKLLIYNTSRLHSGVPSRFSGSGSGTDFTLTISSLQPEDFATYYCQQSNMFPYTFGQGTKLEIK

SEQ ID NO: 4173 - protein, 113 aa, Artificial Sequence
  Synthetic Polypeptide
DIVMTQSPSSLAMSVGQKVTMTCKSSQSLLNSSNQKNYLAWYQQKPGQSPKLLVYFASTRESGVPDRFIGSGSGTDFTLTISSVQAEDLADYFCHQHYSTPLTFGAGTKLELK

SEQ ID NO: 4174 - protein, 111 aa, Artificial Sequence
  Synthetic Polypeptide
QSVVTQPPSVSAAPGQKVTISCSGSSSNIGNNYVSWYQQLPGTAPKLLIYDNNKRPSGIPDRFSASKSGTSATLGITGLQTRDEADYYCGTWDSSLSAWVFGGGTKLTVLG

SEQ ID NO: 4175 - protein, 112 aa, Artificial Sequence
  Synthetic Polypeptide
DVLMTQTPLSLPVSLGDQASISCRSSQSIVHRTGNTYLEWYLQKPGQSPKLLIYKVSNRFSGVPDRFSGSGSGTDFTLKISRVGAEDLGVYYCFQGSHVPYTFGGGTKLEIK

SEQ ID NO: 4176 - protein, 111 aa, Artificial Sequence
  Synthetic Polypeptide
ELVMTQSPASLAVSLGQRATISCRASESVDSYGKSFMHWYQLKPGQPPKLLIYRASNLESGVPARFSGSGSRTDFTLTIDPVEADDAATYYCQQNNEDPWTFGGGTKLEIK

SEQ ID NO: 4177 - protein, 112 aa, Artificial Sequence; identical to SEQ ID NO: 3936
  Synthetic Polypeptide

SEQ ID NO: 4178 - protein, 112 aa, Artificial Sequence; identical to SEQ ID NO: 3932
  Synthetic Polypeptide

SEQ ID NO: 4179 - protein, 107 aa, Artificial Sequence
  Synthetic Polypeptide
DVVMTQSPSSLSASVGDRVTITCMASEDIYIRLAWYQQKPGNAPKLLIYAATSLETGVPSRFSGSGSGTDFTLTISSLQPEDFATYYCQQYWSSPWTFGGGTKVEIK

SEQ ID NO: 4180 - protein, 113 aa, Artificial Sequence
  Synthetic Polypeptide
DVLMTQTPVSLSVSLGDQASISCRSSQSIVHSTGNTYLEWYLQKPGQSPKLLIYKISNRFSGVPDRFSGSGSGTDFTLKISRVEAEDLGVYYCFQASHAPRTFGGGTKLEIKR

SEQ ID NO: 4181 - protein, 106 aa, Artificial Sequence
  Synthetic Polypeptide
SSELTQDPAVSVALGQTVRITCQGDSLRSYYASWYQQKPGQAPVLVIYGKNNRPSGIPDRFSGSSSGNTASLTITGAQAEDEADYYCNSRDSSGWVFGGGTKLTVL

SEQ ID NO: 4182 - protein, 112 aa, Artificial Sequence
  Synthetic Polypeptide
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTLVYVFGTGTKVTVL

SEQ ID NO: 4183 - protein, 110 aa, Artificial Sequence
  Synthetic Polypeptide
QSVLTQPRSVSGSPGQSVTISCTGTSSDVGGYNYVSWYQQHPGEAPKLIIYDADKRPSGISNRFSSGKSGNTASLTISGLQVEDEADYYCCSYAGGSTWVFGGGTKVTVL

SEQ ID NO: 4184 - protein, 112 aa, Artificial Sequence
  Synthetic Polypeptide
QSALTQPASVSGSPGQSITISCTGTSSDVGGYNYVSWYQQHPGKAPKVIISEVNNRPSGVSHRFSGSKSGNTASLTISGLQAEDEADYFCSSYTSGRTLYVFGTGSKVTVLG

SEQ ID NO: 4185 - protein, 127 aa, Artificial Sequence
  Synthetic Polypeptide
EVQLQQSGPGLVKPSQTLSLTCAISGDSMLSNSDTWNWIRQSPSRGLEWLGRTYHRSTWYDDYASSVRGRVSINVDTSKNQYSLQLNAVTPEDTGVYYCARVRLQDGNSWSDAFDVWGQGTMVTVSS

SEQ ID NO: 4186 - protein, 107 aa, Artificial Sequence
  Synthetic Polypeptide
DVVMTQSPSSLSASVGDRVTITCRASQDISKYLNWYQQKPGKAPKLLIYHTSRLHSGVPSRFSGSGSGTDFTLTISSLQPEDFATYYCQQGNTLPYTFGGGTKVEIK

SEQ ID NO: 4187 - protein, 109 aa, Artificial Sequence
  Synthetic Polypeptide
EIVLTQSPATLSLSPGERATLSCSASSSVSYMYWYQQKPGQAPRLLIYRTSNLASGIPARFSGSGSGTDFTLTISSLEPEDFAVYYCQQYHSYPTTFGQGTKVEIKRTV

SEQ ID NO: 4188 - protein, 107 aa, Artificial Sequence
  Synthetic Polypeptide
DVVMTQSPSSLSASVGDRVTITCKASEDIYIRLAWYQQKPGKAPKLLIYAATSLETGVPSRFSGSGSGTDFTLTISSLQPEDFATYYCQQYWTTPWTFGGGTKVEIK

SEQ ID NO: 4189 - protein, 108 aa, Artificial Sequence
  Synthetic Polypeptide
DIQLTQSPSFLSASVGDRVTITCRASQGISTDLNWYQQKPGKAPKLLIYAASNLESGVPSRFSGSGSGTEFTLTISSLQPEDFATYYCQQSYNWPYTFGGGTKVEIKR

SEQ ID NO: 4190 - protein, 108 aa, Artificial Sequence
  Synthetic Polypeptide
DIQLTQSPSFLSASVGDRVTITCSLSLGISTWRDWFPPRLGRGLEPLTYAASTLQSGVPSRFSGSGSGTEFTLTISSLQPEDFATYYCQQLNSYPLTFGGGTKVEIKR

SEQ ID NO: 4191 - protein, 15 aa, Artificial Sequence
  Synthetic Polypeptide
GGGGSGGGGSGGGGS

SEQ ID NO: 4192 - protein, 15 aa, Artificial Sequence
  Synthetic Polypeptide
GGGGSGGGGSGGGGS

SEQ ID NO: 4193 - protein, 15 aa, Artificial Sequence
  Synthetic Polypeptide
GGGGSGGGGSGGGGS

SEQ ID NO: 4194 - protein, 15 aa, Artificial Sequence
  Synthetic Polypeptide
GGGGSGGGGSGGGGS

SEQ ID NO: 4195 - protein, 15 aa, Artificial Sequence
  Synthetic Polypeptide
GGGGSGGGGSGGGGS

SEQ ID NO: 4196 - protein, 15 aa, Artificial Sequence
  Synthetic Polypeptide
GGGGSGGGGSGGGGS

SEQ ID NO: 4197 - protein, 35 aa, Artificial Sequence
  Synthetic Polypeptide
GGSGSGGGGSGGGGSGSGGSGSGGSGSGGSGSGGS

SEQ ID NO: 4198 - protein, 35 aa, Artificial Sequence
  Synthetic Polypeptide
GGGGSGGGGSGGGGSGSGGSGSGGSGSGGSGSGGS

SEQ ID NO: 4199 - protein, 25 aa, Artificial Sequence
  Synthetic Polypeptide
SSADDAKKDAAKKDDAKKDDAKKDG

SEQ ID NO: 4200 - protein, 40 aa, Artificial Sequence
  Synthetic Polypeptide
GSAWSHPQFEKGGGSGGGSGGSAWSHPQFEKSRSSGGGGS

SEQ ID NO: 4201 - protein, 7 aa, Artificial Sequence
  Synthetic Polypeptide
PGGGGSP

SEQ ID NO: 4202 - protein, 7 aa, Artificial Sequence
  Synthetic Polypeptide
PGGGGSP

SEQ ID NO: 4203 - protein, 7 aa, Artificial Sequence
  Synthetic Polypeptide
EVAALER

SEQ ID NO: 4204 - protein, 7 aa, Artificial Sequence
  Synthetic Polypeptide
RVAALKE

SEQ ID NO: 4205 - protein, 5 aa, Artificial Sequence
  Synthetic Polypeptide
EAAAK

SEQ ID NO: 4206 - protein, 5 aa, Artificial Sequence
  Synthetic Polypeptide
EAAAK

SEQ ID NO: 4207 - protein, 117 aa, Artificial Sequence
  Synthetic Polypeptide
EVQLVQSGAEVKKPGESLTISCKASGYSFPNYWITWVRQMSGGGLEWMGRIDPGDSYTTYNPSFQGHVTISIDKSTNTAYLHWNSLKASDTAMYYCARYYVSLVDIWGQGTLVTVSS

SEQ ID NO: 4208 - protein, 124 aa, Artificial Sequence
  Synthetic Polypeptide
EVQLVESGGGLVKPGGSLRLSCAASGFTFSNAWMSWVRQAPGKGLEWVGFIRSKAYGGTTEYAASVKGRFTISRDDSKSIAYLQMNNLKTEDTAVYYCARDGLYSSSWYDSDYWGQGTLVTVSS

SEQ ID NO: 4209 - protein, 126 aa, Artificial Sequence
  Synthetic Polypeptide
QMQLVQSGGGLVQPGRSLRLSCAASGFTFDDYAMHWVRQAPGKGLEWVSGISWNSGSIGYADSVKGRFTISRDNAKNSLYLQMNSLRAEDTALYYCAKDIHSGSYYGLLYYAMDVWGQGTTVTVSS

SEQ ID NO: 4210 - protein, 125 aa, Artificial Sequence
  Synthetic Polypeptide
GGGGSQVQLQQSGAELVKPGASVKISCKASGYAFSSYWMNWVKQRPGKGLEWIGQIYPGDGDTTYNGKFKGKATLTADKSSSTVYMQLNSLTSEDSAVYFCVRYYYGSSGYFDYWGQGTTLTVSS

SEQ ID NO: 4211 - protein, 120 aa, Artificial Sequence
  Synthetic Polypeptide
ALQLQQSGAELVRPGASVTLSCKASGYTFTDYEMHWVKQTPVHGLEWIGAIDPETGGTAYNQKFEGKAILTADKSSSTAYMELRSLTSEDSPVYYCARRRYYGSSSFDYWGQGTTLTVSS

SEQ ID NO: 4212 - protein, 123 aa, Artificial Sequence
  Synthetic Polypeptide
EVQLVESGGGLVQPGGSLRLSCSASGFTFSSFGMHWVRQAPGKGLEWVAYISSGSSTIYYGDTVKGRFTISRDNAKNSLFLQMSSLRAEDTAVYYCAREGGYYYGRSYYTMDYWGQGTTVTVS

SEQ ID NO: 4213 - protein, 118 aa, Artificial Sequence
  Synthetic Polypeptide
QVQLVQSGAEVKKPGASVKVSCKASGYTFTDYYMHWVRQAPGQRLEWMGWINPNSGGTNYAQKFQDRITVTRDTSSNTGYMELTRLRSDDTAVYYCARSPYSGVLDKWGQGTLVTVSS

SEQ ID NO: 4214 - protein, 117 aa, Artificial Sequence
  Synthetic Polypeptide
EVQLVQSGAEVKKPGESLKISCKGSGYDFTTYWIGWVRQMPGKGLEWMGIIYPGDSDTRYSPSVRGRVTISADKSINTAYLQWSSLEASDTAMYYCARMWTFSQDGWGQGTLVTVSS

SEQ ID NO: 4215 - protein, 117 aa, Artificial Sequence
  Synthetic Polypeptide
QVQLVQSGPEVKKPGESVKISCKASGYTFRHYSMNWVKQAPGQGLKWMGRINTESGVPIYADDFKGRFSFTVDTSASTAYLEISSLTSEDTAVYFCSNDYLYSLDFWGQGTTLTVSS

SEQ ID NO: 4216 - protein, 121 aa, Artificial Sequence
  Synthetic Polypeptide
QVQLVQSGAEVKKPGSSVKVSCKASGGTFSNYWMHWVRQAPGQGLEWMGATYRGHSDTYYNQKFKGRVTITADKSTSTAYMELSSLRSEDTAVYYCARGAIYDGYDVLDNWGQGTLVTVSS

SEQ ID NO: 4217 - protein, 125 aa, Artificial Sequence
  Synthetic Polypeptide
LEMAQVQLVQSGAEVKKPGSSVKVSCKASGGTFSSYAISWVRQAPGQGLEWMGRIIPILGIANYAQKFQGRVTITADKSTSTAYMELSSLRSEDTAVYYCARGGYYSHDMWSEDWGQGTLVTVSS

SEQ ID NO: 4218 - protein, 117 aa, Artificial Sequence
  Synthetic Polypeptide
QVQLVQSGSELKKPGESVKISCKASGYTFTDYSINWVKQAPGQGLKWMGWINTETREPAYAYDFRGRFVFSLDTSASTAYLQISSLKAEDTAVYFCALDYSYAMDYWGQGTLVTVSS

SEQ ID NO: 4219 - protein, 117 aa, Artificial Sequence
  Synthetic Polypeptide
QVQLVQSGSELKKPGESVKISCKASGYTFTHYSMNWVRQAPGQGLEWMGRINTETGEPLYADDFKGRFVFSLDTSASTAYLQISSLKAEDTAVYYCSNDYLYSLDYWGQGTLVTVSS

SEQ ID NO: 4220 - protein, 118 aa, Artificial Sequence
  Synthetic Polypeptide
QVQLVQSGAEVKKPGASVKVSCKASGYTFASQWMHWMRQAPGQGLEWIGWINPGNVNTKYNEKFKGRATLTVDTSTNTAYMELSSLRSEDTAVYYCARSTWYRPLDYWGQGTLVTVSS

SEQ ID NO: 4221 - protein, 120 aa, Artificial Sequence [sequence omitted]

SEQ ID NO: 4222 - protein, 118 aa, Artificial Sequence
  Synthetic Polypeptide
QIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSS

SEQ ID NO: 4223 - protein, 120 aa, Artificial Sequence
  Synthetic Polypeptide
EVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSS

SEQ ID NO: 4224 - protein, 120 aa, Artificial Sequence
  Synthetic Polypeptide
QVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSS

SEQ ID NO: 4225 - protein, 118 aa, Artificial Sequence
  Synthetic Polypeptide
EVQLVQSGAEVKKPGESLKISCKGSGYSFTSYWISWVRQMPGKGLEWMGIIDPSDSDTRYSPSFQGQVTISADKSISTAYLQWSSLKASDTAMYYCARGDGSTDLDYWGQGTLVTVSS

SEQ ID NO: 4226 - protein, 118 aa, Artificial Sequence
  Synthetic Polypeptide
QVQLQESGPGLVKPSETLSLTCTVSGFSLTTYDVHWVRQPPGKGLEWMGRIQNAGITDYNSALKSRLIISRDTSKSQVFLKMNSVTTADTAMYFCAKTGSYFYAFDHWGQGTLVTVSS

SEQ ID NO: 4227 - protein, 119 aa, Artificial Sequence
  Synthetic Polypeptide
QVQLQESGPTLVKPGDSVKMSCKASGYTFTDYIIHWVKQSHGKSLEWIGYINPYSDGTNYNEKFKSKATLTVDKSTSTAYMEFSRLTSEDSAIYFCALNYGSYYAMDAWGQGTSVTVSS

SEQ ID NO: 4228 - protein, 119 aa, Artificial Sequence
  Synthetic Polypeptide
EVQLLESGGGLVQPGGSLRLSCAASGFTFSGYWMHWVRQAPGKGLEWVSAIRSDGSSKYYADSVKGRFTISRDNSKNTLYLQMNSLRAEDTAVYYCAKDGVIEDTFDYWGQGTLVTVSS

SEQ ID NO: 4229 - protein, 115 aa, Artificial Sequence
  Synthetic Polypeptide
QVQLQQPGAELVRPGASVKLSCKASGYTFTSYWMNWVKQRPDQGLEWIGRIDPYDSETHYNQKFKDKAILTVDKSSSTAYMQLSSLTSEDSAVYYCARGNWDDYWGQGTTLTVSS

SEQ ID NO: 4230 - protein, 119 aa, Artificial Sequence
  Synthetic Polypeptide
QVQLQESGPTLVNPGDSVKMSCKASGYTFTDHIIHWVKQSHGKSLEWIGYINPYSGGANYNGKFKSKATLTIDKSSSTAYMEFSRLTSGDSAIYYCALNYGSYYAMDAWGQGTSVTVSS

SEQ ID NO: 4231 - protein, 119 aa, Artificial Sequence
  Synthetic Polypeptide
EVQLVESGGGLVQPGRSLKLSCAASGFTFSDYNMAWVRQAPKKGLEWVATILYDGGRTYYRGSVKGRFTISRDNAKSTLYLRMDSLRSEDTATYYCATHSRGTDYFDYWGQGVMVTVSS

SEQ ID NO: 4232 - protein, 121 aa, Artificial Sequence
  Synthetic Polypeptide
EVKLQESGPSLVQSSQTLSLTCTVSGFSLTSYHIHWVRQTPGKGLEWMGVMWSDGDTSYNSALKSRLSISRDTSQSQVFLKMNSLQTEDTATYYCARGYYSSYLYLWFAYWGQGTLVTVSS

SEQ ID NO: 4233 - protein, 125 aa, Artificial Sequence
  Synthetic Polypeptide
QVQLQQSGPELRRPGSSVRLSCKASGYRIKDFLIHWIKNRPEHGLEWIGWIDPEDGETKYAQKFQTKATLTADTSSNTAYMQLSSLTSEDTATYFCARWGDVYYGLMRGHVMDAWGQGTSVTVSS

SEQ ID NO: 4234 - protein, 122 aa, Artificial Sequence
  Synthetic Polypeptide
QVQLQQSGSELMMPGASVKISCKATGYTFSNYWIEWVKQRPGHGLEWIGEILPGTGRTIYNEKFKGKATFTADISSNTVQMQLSSLTSEDSAVYYCARRDYYGNFYYAMDYWGQGTSVTVSS

SEQ ID NO: 4235 - protein, 118 aa, Artificial Sequence
  Synthetic Polypeptide
EVQLQQSGPELVKPGASVKMSCKASGYTFTDYYMKWMKQSHGKSLEWIGDINPNNGGTTYNQKFKGKATLTVDKSSSTAYMQLNSLTSEDSAVYYCARDYGYGYFDYWGQGTTLTVSS

SEQ ID NO: 4236 - protein, 121 aa, Artificial Sequence
  Synthetic Polypeptide
EVQLQQSGPELIKPGASVKMSCKASGYTFTSYVMHWVKQKPGQGLEWIGYINPYNDGTKYNEKFKGKATLTSDKSSSTAYMELSSLTSEDSAVYYCARGTYYYGSRVFDYWGQGTTLTVSS

SEQ ID NO: 4237 - protein, 120 aa, Artificial Sequence
  Synthetic Polypeptide
QVQLQESGPGLVKPSQTLSLTCTVSGGSISTSGMGVGWIRQHPGKGLEWIGHIWWDDDKRYNPALKSRVTISVDTSKNQFSLKLSSVTAADTAVYYCARMELWSYYFDYWGQGTLVTVSS

SEQ ID NO: 4238 - protein, 120 aa, Artificial Sequence; identical to SEQ ID NO: 4237
  Synthetic Polypeptide

SEQ ID NO: 4239 - protein, 124 aa, Artificial Sequence
  Synthetic Polypeptide
QVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSS

SEQ ID NO: 4240 - protein, 120 aa, Artificial Sequence
  Synthetic Polypeptide
EVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSS

SEQ ID NO: 4241 - protein, 119 aa, Artificial Sequence
  Synthetic Polypeptide
VKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSS

SEQ ID NO: 4242 - protein, 120 aa, Artificial Sequence
  Synthetic Polypeptide
QVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSS

SEQ ID NO: 4243 - protein, 121 aa, Artificial Sequence
  Synthetic Polypeptide
EVQLVESGGGLVQPGGSLRLSCAASGFTFSSSWMNWVRQAPGKGLEWVGRIYPGDGDTNYNGKFKGRFTISRDDSKNSLYLQMNSLKTEDTAVYYCARSGFITTVLDFDYWGQGTLVTVSS

SEQ ID NO: 4244 - protein, 121 aa, Artificial Sequence
  Synthetic Polypeptide
EVQLVQSGAEVKKPGESLKISCKGSGYSFSSSWIGWVRQMPGKGLEWMGIIYPDDSDTRYSPSFQGQVTISADKSIRTAYLQWSSLKASDTAMYYCARHVTMIWGVIIDFWGQGTLVTVSS

SEQ ID NO: 4245 - protein, 121 aa, Artificial Sequence
  Synthetic Polypeptide
EVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSS

SEQ ID NO: 4246 - protein, 123 aa, Artificial Sequence
  Synthetic Polypeptide
QVQLVESGGGLVEPGGSLRLSCMSGYAFSSYWMNWVRQMPGKGLEWMGQIWPGDGDTNYNPSLKSRVTITADESTSTAYMELSSLKAEDTAVYFCARRETTTVGRYYYAMDYWGQGTLVTVSS

SEQ ID NO: 4247 - protein, 120 aa, Artificial Sequence
  Synthetic Polypeptide
QVQLVESGGGLVEPGGSLRLSCMSGYAFSSSWMNWVRQMPGKGLEWMGRIYPGDGDTNYNGKFKERVTITADESTSTAYMELSSLKAEDTAVYFCARSEYWGNYWAMDYWGQGTLVTVSS

SEQ ID NO: 4248 - protein, 121 aa, Artificial Sequence
  Synthetic Polypeptide
QVQLVESGGGLVEPGGSLRLSCMSGYAFSSYWMNWVRQMPGKGLEWMGQIYPGDGDTNYNGKFKGRVTITADESTSTAYMELSSLKAEDTAVYFCARKTISSVVDFYFDNWGQGTLVTVSS

SEQ ID NO: 4249 - protein, 120 aa, Artificial Sequence
  Synthetic Polypeptide
QVQLEQPGAEVVKPGASVKVSCKTSGYTFTSNWMHWVKQTPGKGLEWIGEIDPSDSYTNYNQKFDGKAKLTVDKSSSTAYMEVSDLTAEDSATYYCARGSNPYYYAMDYWGQGTSVTVSS

SEQ ID NO: 4250 - protein, 121 aa, Artificial Sequence
  Synthetic Polypeptide
QVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSS

SEQ ID NO: 4251 - protein, 124 aa, Artificial Sequence
  Synthetic Polypeptide
QVQLQQSGAEVKKPGSSVKVSCKASGYAFSSYWMNWVRQRPGQGLEWIGQIWPGDGDTNYNGKFKGRATITADESTNTAYMELSSLRSEDTAFYSCARRETTTVGRYYYAMDYWGQGTTVTVSS

SEQ ID NO: 4252 - protein, 122 aa, Artificial Sequence
  Synthetic Polypeptide
EVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSS

SEQ ID NO: 4253 - protein, 119 aa, Artificial Sequence
  Synthetic Polypeptide
QVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSS

SEQ ID NO: 4254 - protein, 122 aa, Artificial Sequence
  Synthetic Polypeptide
EVQLQQSGAELKKPGASVKVSCKASGYTFTSYNMHWVKQTPGQGLEWIGAIYPGNGDTSYNQKFKGKTTLTADKSSSTAYMELSSLRSEDTAVYYCARSNYYGSSYWFFDVWGTGTTVTVSS

SEQ ID NO: 4255 - protein, 125 aa, Artificial Sequence
  Synthetic Polypeptide
EVQLVQSGGGLVHPGGSLRLSCTGSGFTFSYHAMHWVRQAPGKGLEWVSIIGTGGVTYYADSVKGRFTISRDNVKNSLYLQMNSLRAEDMAVYYCARDYYGAGSFYDGLYGMDVWGQGTTVTVSS

SEQ ID NO: 4256 - protein, 123 aa, Artificial Sequence
  Synthetic Polypeptide
AVQLVESGGGLVQPGRSLRLSCAASGFTFGDYTMHWVRQAPGKGLEWVSGISWNSGSIGYADSVKGRFTISRDNAKNSLYLQMNSLRAEDTALYYCTKDNQYGSGSTYGLGVWGQGTLVTVSS

SEQ ID NO: 4257 - protein, 122 aa, Artificial Sequence [sequence omitted]

SEQ ID NO: 4258 - protein, 121 aa, Artificial Sequence
  Synthetic Polypeptide
QVQLQQSGAEVKKPGSSVKVSCKASGYTFTSYNMHWVKQAPGQGLEWIGAIYPGNGDTSYNQKFKGKATLTADESTNTAYMELSSLRSEDTAFYYCARSTYYGGDWYFDVWGQGTTVTVSS

SEQ ID NO: 4259 - protein, 128 aa, Artificial Sequence
  Synthetic Polypeptide
QIQLVQSGSELKKPGASVKVSCKASGYTFTNFGVNWVRQAPGKGLEWMGWINTYTGEPSYAQGFTGRFVFSLDASVSTAYLQISSLKAEDTATYFCTRRTNYYGTSYYYAMDYWGQGTTVTVSSAKTT

SEQ ID NO: 4260 - protein, 120 aa, Artificial Sequence
  Synthetic Polypeptide
QAYLQQSGAELVRPGASVKMSCKASGYTFTSYNMHWVKQTPRQGLEWIGGIYPGNGDTSYNQKFKGKATLTVGKSSSTAYMQLSSLTSEDSAVYFCARYDYNYAMDYWGQGTSVTVSSAS

SEQ ID NO: 4261 - protein, 122 aa, Artificial Sequence [sequence omitted]

SEQ ID NO: 4262 - protein, 122 aa, Artificial Sequence
  Synthetic Polypeptide
QVQLVQSGAEVKKPGASVKVSCKASGYTFTSYNMHWVRQAPGQRLEWIGAIYPGNGDTSYNQKFKGRVTVTRDTSANTAYMELSSLKSEDTAVYYCARSHYGSNYVDYFDYWGQGTLVTVSS

SEQ ID NO: 4263 - protein, 122 aa, Artificial Sequence
  Synthetic Polypeptide
EVQLVESGGGLVQPDRSLRLSCAASGFTFHDYAMHWVRQAPGKGLEWVSTISWNSGTIGYADSVKGRFTISRDNAKNSLYLQMNSLRAEDTALYYCAKDIQYGNYYYGMDVWGQGTTVTVSS

SEQ ID NO: 4264 - protein, 121 aa, Artificial Sequence
  Synthetic Polypeptide
EVQLVQSGAEVKKPGESLKLSCKGSGRTFTSYNMHWVRQMPGKGLEWMGAIYPLTGDTSYNQKSKLQVTISADKSISTAYLQWSSLKASDTAMYYCARSTYVGGDWQFDVWGKGTTVTVSS

SEQ ID NO: 4265 - protein, 120 aa, Artificial Sequence
  Synthetic Polypeptide
EVQLVESGGGLVQPGGSLRLSCAASGYEFSRSWMNWVRQAPGKGLEWVGRIYPGDGDTNYSGKFKGRFTISADTSKNTAYLQMNSLRAEDTAVYYCARDGSSWDWYFDVWGQGTLVTVSS

SEQ ID NO: 4266 - protein, 117 aa, Artificial Sequence
  Synthetic Polypeptide
QVQLEESGGGVVRPGRSLRLSCAASGFTFSDYGVNWIRQAPGKGLEWVTIIWGDGRTDYNSALKSRFTVSRNNSNNTLSLQMNSLTTEDTAVYYCVRAPGNRAMEYWGQGVLVTVSS

SEQ ID NO: 4267 - protein, 124 aa, Artificial Sequence
  Synthetic Polypeptide
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSS

SEQ ID NO: 4268 - protein, 117 aa, Artificial Sequence
  Synthetic Polypeptide
QVQLVQSGAEVKKPGSSVKVSCKASGGTFSSYAISWVRQAPGQGLEWMGGIIPILGTANYAQKFQGRVTITADESTSTAYMELSSLRSEDTAVYYCARWGGGAFDIWGQGTMVTVSS

SEQ ID NO: 4269 - protein, 112 aa, Artificial Sequence
  Synthetic Polypeptide
QVQLQQWGAGLLKPSETLSLTCAVYGGSFSAYYWSWIRQPPGKGLEWIGDINHGGGTNYNPSLKSRVTISVDTSKNQFSLKLNSVTAADTAVYYCASLTAYWGQGSLVTVSS

SEQ ID NO: 4270 - protein, 117 aa, Artificial Sequence
  Synthetic Polypeptide
QVQLVQSGAEVKKPGASVKVSCKVSGYTFTDYYITWVRQAPGQALEWMGWIYPGSGNTKYSQKFQGRFVFSVDTSASTAYLQLSSLKAEDTAVYYCANYGNYWFAYWGQGTLVTVSS

SEQ ID NO: 4271 - protein, 119 aa, Artificial Sequence
  Synthetic Polypeptide
EVQLVQSGGGLVHPGGSLRLSCAGSGFAFSSSTMHWIRQAPGKGLEWISLIGSGGGIYYGDSVKGRFTISRDNAKNSLYLQMNSLRAEDMAVYYCVRGYFDWVDYFDYWGQGTLVTVSS

SEQ ID NO: 4272 - protein, 120 aa, Artificial Sequence
  Synthetic Polypeptide
EVQLVESGGGLVQPGGSLRLSCAASGFTFSSYGMHWVRQAPGKGLEWVAYITTRSSTIYYADSVKGRFTISRDNAKNSLYLQMNSLRAEDTAVYYCTREPLTGYYAMDYWGQGTSVTVSS

SEQ ID NO: 4273 - protein, 116 aa, Artificial Sequence
  Synthetic Polypeptide
DVQLQESGPGLVKPSQSLSLTCTVTGFSITSDYSWNWIRQFPGNKLEWMGYISYSGHTSYNPSLESRISITRDTSKNQFFLQLNSVTTEDTATYYCTRGNWDVVYWGQGTLVTVSA

SEQ ID NO: 4274 - protein, 118 aa, Artificial Sequence
  Synthetic Polypeptide
QVQLQQPGAEVVKPGASVKMSCKASGYTFTSYYIHWIKQTPGQGLEWVGVIYPGNDDISYNQKFQGKATLTADKSSTTAYMQLSSLTSEDSAVYYCAREVRLRYFDVWGQGTTVTVSS

SEQ ID NO: 4275 - protein, 122 aa, Artificial Sequence
  Synthetic Polypeptide
QVQLVQSGAEVKKPGASVKVSCKASGYTFTNYGMNWVKQAPGQGLKWMGWINTYTGEPTYADDFKGRVTMTSDTSTSTAYLELHNLRSDDTAVYYCARWSWSDGYYVYFDYWGQGTTVTVSS

SEQ ID NO: 4276 - protein, 119 aa, Artificial Sequence
  Synthetic Polypeptide
QVQLVQSGAEVKKPGSSVKVSCKASGGTFSDYAISWVRQAPGQGLEWMGRIIPILGVANYAQKFQGRVTITADKSTRTAYMELSSLRSEDTAVYYCARNWADAFDIWGQGTMVTVSSAS

SEQ ID NO: 4277 - protein, 122 aa, Artificial Sequence
  Synthetic Polypeptide
EVKLQQSGPELVKPGTSVKVSCKASGYSFTDYNMYWVKQSHGKSLEWIGYIDPYKGGTIYNQKFKGKATLTVDKSSSTAFMHLNSLTSEDSAVYYCAREMITAYYFDYWGQGSSVTVSSLER

SEQ ID NO: 4278 - protein, 117 aa, Artificial Sequence
  Synthetic Polypeptide
QVQLVQSGAEVKKPGASVKVSCKASGYTFTNYDINWVRQAPGQGLEWIGWIYPGDGSTKYNEKFKAKATLTADTSTSTAYMELRSLRSDDTAVYYCASGYEDAMDYWGQGTTVTVSS

SEQ ID NO: 4279 - protein, 117 aa, Artificial Sequence
  Synthetic Polypeptide
QVQLVQSGAEVKKPGSSVKVSCKASGGIFSNHAISWVRQAPGQGLEWMGGIIPIFGTANYAQKFQGRVTITADESTSTAFMELSSLRSEDTAVYYCAREWADVFDIWGQGTMVTVSS

SEQ ID NO: 4280 - protein, 117 aa, Artificial Sequence
  Synthetic Polypeptide
EVQLQQSGAELVKPGASVKMSCKAFGYTFTTFPIEWMKQSHGKSLEWIGNFHPYNDQTKYNEEFKGRAKLTIDRSSSTVYLELGRLTSDDSAVYYCARGYYYAFDFWGQGTTLTVSS

SEQ ID NO: 4281 - protein, 117 aa, Artificial Sequence; identical to SEQ ID NO: 4280
  Synthetic Polypeptide

SEQ ID NO: 4282 - protein, 118 aa, Artificial Sequence
  Synthetic Polypeptide
EVQLVESGGALIQPGGSLRLSCVASGFTISGNYMSWVRQAPGKGLEWVSLIYSGDSTYYADSVKGRFTISRDISKNTVYLQMNSLRVEDTAVYYCVRDGYYVSDMVVWGKGTTVTVSS

SEQ ID NO: 4283 - protein, 122 aa, Artificial Sequence
  Synthetic Polypeptide
QIQLVQSGSELKKPGASVKVSCKASGYTFTNYGMNWVRQAPGQGLKWMGWINTNTGEPKYAEEFKGRFALSLDTSVSTAYLQINSLKAEDTAVYFCARGYGNYARGAWLAYWGQGTLVTVSS

SEQ ID NO: 4284 - protein, 114 aa, Artificial Sequence
  Synthetic Polypeptide
EVQLVESGGGLVKPGGSLRLSCAASGFTFSSYDMSWVRQAPGKGLEWVSTISSGGSYTYYLDSIKGRFTISRDNAKNSLYLQMNSLRAEDTAVYYCARQGLDYWGRGTLVTVSS

SEQ ID NO: 4285 - protein, 121 aa, Artificial Sequence
  Synthetic Polypeptide
QVQLKESGPELEKPGASVKISCKASGYSFTAYSMNWVKQNNGMSLEWIGSIDPYYGDTKYAQKFKGKATLTVDKASSTAYLQLKSLTSEDSAVYYCARRMITTGDWYFDVWGAGTTVTVSS

SEQ ID NO: 4286 - protein, 121 aa, Artificial Sequence; identical to SEQ ID NO: 4285
  Synthetic Polypeptide

SEQ ID NO: 4287 - protein, 118 aa, Artificial Sequence
  Synthetic Polypeptide
QVQLVQSGAEVKKPGASVKVSCKASGYTFTNYGMNWVRQAPGQGLEWMGWINTYTGEPTYADAFKGRFAFSLDTSTSTAYLQINSLRSDDTAVYYCARDYGDYGMDYWGQGTTVTVSS

SEQ ID NO: 4288 - protein, 113 aa, Artificial Sequence
  Synthetic Polypeptide
QVQLQQPGAELVRPGASVKLSCKASGYTFTSYWMNWVKQRPGQGLEWIGMIDPSDSETHYNHIFKDKATLTVDKSSSTAYLQLSSLTSEDSAVYYCARNLYLWGQGTSVTVSS

SEQ ID NO: 4289 - protein, 117 aa, Artificial Sequence [sequence omitted]

SEQ ID NO: 4290 - protein, 114 aa, Artificial Sequence
  Synthetic Polypeptide
QVQLVQSGAEVKKPGASVKVSCKASGYTFKDTYIHWVRQAPGQGLEWMGRIDPANGNTKYDPKFQGRVTMTRDTSISTAYMELSRLRSDDTAVYYCARRGGVDWGQGTLVTVSS

SEQ ID NO: 4291 - protein, 123 aa, Artificial Sequence
  Synthetic Polypeptide
EVQLQQSVAELVKPGASVKMSCKVSGYTLTDHTIHWMKQRPEQGLEWIGYIYPRDGITGYNEKFKGKATLTADTSSSTAYMQLNSLTSEDSAVYFCARWGYSYRNYAYYYDYWGQGTTLTVSS

SEQ ID NO: 4292 - protein, 125 aa, Artificial Sequence
  Synthetic Polypeptide
QVQLQESGPGLAKPSETLSLTCTVSGDSITSYYWSWIRQPPGKGLEWIGYIYYSGSTNYNPSLKSRVTISVDTSKNQFSLKLSSVTAADTAVYYCARDQRRIAAAGTHFYGMDVWGQGTTVTVSS

SEQ ID NO: 4293 - protein, 116 aa, Artificial Sequence
  Synthetic Polypeptide
QVQLLESGGGLVQPGGSLRLSCAASGFTFSSYAMSWVRQAPGKGLEWVSVIRSSGSSTYYADSVKGRFTISRDNSKNTLYLQMNSLRAEDTAVYYCARGGGYFDYWGQGTLVTVSS

SEQ ID NO: 4294 - protein, 118 aa, Artificial Sequence
  Synthetic Polypeptide
QVQLLESGGGLVQPGGSLRLSCAASGFTFSSHGMHWVRQAPGKGLEWVSVISGSGSNTGYADSVKGRFTISRDNSKNTLYLQMNSLRAEDTAVYYCARQWGSYAFDSWGQGTLVTVSS

SEQ ID NO: 4295 - protein, 118 aa, Artificial Sequence
  Synthetic Polypeptide
QVQLEESGPELVKPGASVKLSCKASGYTFTEYIIHWVKQRSGQGLEWIGWFYPGSGSIKYNEKFKDKATLTADKSSSTVYMELSGLTSEDSAVYFCARHDGYSYFDYWGQGTTLTVSS

SEQ ID NO: 4296 - protein, 115 aa, Artificial Sequence
  Synthetic Polypeptide
ESGRGLVQPGGSRKLSCAASGFTFSTSGMHWVRQAPEKGLEWVAYISSGSTTIYHADTVKGRFTISRDNPKNTLFLQMTSLRSEDTAMYYCCARSGQFGNYFDYWGQGTTLTVSS

SEQ ID NO: 4297 - protein, 120 aa, Artificial Sequence
  Synthetic Polypeptide
EVQLQQSGPELVKPGASVKMSCKASGYTFTSYFIHWVKQKPGQGLEWIGFINPYNDGSKYNEKFKGKATLTSDKSSSTAYMELSSLTSEDSAVYYCTRDDGYYGYAMDYWGQGTSVTVSS

SEQ ID NO: 4298 - protein, 120 aa, Artificial Sequence
  Synthetic Polypeptide
EVQLQQSGPELVKPGASVKMSCKASGYTFTSYVMHWVKQKPGQGLEWIGYINPYNDGTKYNEKFKGKATLTSDTSSSTAYMELNSLTSEDSAVYFCARPIYFDNDYFDYWGQGTTLKVSS

SEQ ID NO: 4299 - protein, 121 aa, Artificial Sequence
  Synthetic Polypeptide
EVQLVQSGAEVKKPGASVKVSCKASGYTFTDYYLDVVVRQAPGQGLEWIGRVNPYNGGTIYNQKFKGRVTLTRDTSTSTAYLELSSLRSEDTAVYYCARDHYRYDPLLDYWGQGTLVTVSS

SEQ ID NO: 4300 - protein, 122 aa, Artificial Sequence
  Synthetic Polypeptide
EVQLVQSGAEVKKPGASVKVSCKASGYSFTDYYMHWVRQAPGQGLEWIGRINPYNGAAFYSQNFKDRVTLTVDTSTSTAYLELSSLRSEDTAVYYCAIERGADLEGYAMDYWGQGTLVTVSS

SEQ ID NO: 4301 - protein, 123 aa, Artificial Sequence
  Synthetic Polypeptide
QVQLQESGPGLVKPSETLSLTCAVSGYSITSAYYWNWIRQPPGKGLEWIGYISYDGRNNYNPSLKNRITINPDTSKNQFSLQLNSVTPEDTAVYYCAREGDYDVGNYYAMDYWGQGTLVTVSS

SEQ ID NO: 4302 - protein, 123 aa, Artificial Sequence
  Synthetic Polypeptide
EVQLVESGGGLVQPGRSLRLSCAASGYSITSAYYWNWVRQAPGKGLEWVSYISYDGRNNYNPSLKNRFTISRDNAKKSLYLQMNSLRAEDTALYYCAKEGDYDVGNYYAMDYWGQGTTVTVSS

SEQ ID NO: 4303 - protein, 122 aa, Artificial Sequence
  Synthetic Polypeptide
QVQLQESGPGLVKPSETLSLTCTVSGGSISSSNYYWGWIRQPPGKGLEWIGAIYYSGSTYYNPSLKSRVAISVDTSKNQFSLKLSSVTAADTAVYYCARRIGVAGQWYFDLWGRGTLVTVSS

SEQ ID NO: 4304 - protein, 122 aa, Artificial Sequence
  Synthetic Polypeptide
QIQLVQSGPDLKKPGETVKISCKASGYTFTNTGMNWVKQAPGKGLKWMGWINTYTGEPTYADDFKGRFTFSLETSASTAYLQINNLKNEDTATYFCTRWGYGSSLYYAMDYWGQGTSVTVSS

SEQ ID NO: 4305 - protein, 119 aa, Artificial Sequence
  Synthetic Polypeptide
EVQLVESGGGLVQPGGSLRLSCAASGFDFSRYWMSWVRQAPGKGLEWIGEINPDSSTINYAPSLKDKFIISRDNAKNSLYLQMNSLRAEDTAVYYCARPDGNYWYFDVWGQGTLVTVSS

SEQ ID NO: 4306 - protein, 120 aa, Artificial Sequence
  Synthetic Polypeptide
QVQLQQPGAELVRPGASVKLSCKASGYSFTTYWMNWVKQRPGQGLEWIGMIHPSDSETRLNQKFKDKATLTVDKSSSTAYMQLSSPTSEDSAVYYCARSTMIATRAMDYWGQGTSVTVSS

SEQ ID NO: 4307 - protein, 120 aa, Artificial Sequence
  Synthetic Polypeptide
QVQLVQSGAEVKKPGASVKVSCKASGYAFSSSWMNWVRQAPGQGLEWIGRIYPGDGDTKYNGKFKGKATLTADKSTSTAYMELSSLRSEDTAVYYCARSTMIATGAMDYWGQGTLVTVSS

SEQ ID NO: 4308 - protein, 117 aa, Artificial Sequence
  Synthetic Polypeptide
EVQLVESGGGLVQPGGSLRLSCAASGFTFSDYYMAWVRQAPGKGLEWVAEINYDGSSTYYVDSVKGRFTISRDNAKNSLYLQMNSLRAEDTAVYYCARDRGFYFDYWGQGTTVTVSS

SEQ ID NO: 4309 - protein, 117 aa, Artificial Sequence
  Synthetic Polypeptide
EVQLVESGGGLVQPGGSLRLSCAASGFTFSDYYMAWVRQAPGKGLEWVASINYDGESTYYVDSVKGRFTISRDNAKNSLYLQMNSLRAEDTAVYYCARDRGYYFDYWGQGTTVTVSS

SEQ ID NO: 4310 - protein, 117 aa, Artificial Sequence
  Synthetic Polypeptide
EVQLVESGGGLVQPGGSLRLSCAASGFTFSDYYMAWVRQAPGKGLEWVADINYDGGSTYYLDSLKSRFTISRDNAKNSLYLQMNSLRAEDTAVYYCARDRGYYFDYWGQGTLVTVSS

SEQ ID NO: 4311 - protein, 121 aa, Artificial Sequence
  Synthetic Polypeptide
QVQLQQSGAELARPGASVKLSCKASGYTFTSYWMQWVKQRPGQGLEWIGAIYPGDGDTRYTQKFKGKATLTADKSSSTAYMQLSSLASEDSAVYYCARGKVYYGSNPFAYWGQGTLVTVSA

SEQ ID NO: 4312 - protein, 120 aa, Artificial Sequence
  Synthetic Polypeptide
QVQLQQSGPELVKPGASVKISCKASGYAFSSSWMNWVKQRPGQGLEWIGRIYPGDGDTKYNGKFKGKATLTADKSSSTAYMQLSSLTSVDSAVYFCARSTMIATGAMDYWGQGTSVTVSS

SEQ ID NO: 4313 - protein, 120 aa, Artificial Sequence
  Synthetic Polypeptide
QVQLVQSGAEVKKPGASVKVSCKVSGYTLTELSIHWVRQAPGKGLEWMGGFDPEENEIVYAQRFQGRVTMTEDTSTDTAYMELSSLRSEDTAVYYCAIVGSFSGIAYRPWGQGTMVTVSS

SEQ ID NO: 4314 - protein, 120 aa, Artificial Sequence
  Synthetic Polypeptide
QVQLVQSGAEVKKPGASVKVSCKVSGYTLTELSIHWVRQAPGKGLEWMGGFDPEENEIVYAQRFQGRVTMTEDTSTDTAYMELSSLRSEDTAVYYCAIVGSFSPLTLGLWGQGTMVTVSS

SEQ ID NO: 4315 - protein, 124 aa, Artificial Sequence
  Synthetic Polypeptide
QITLKESGPTLVKPTQTLTLTCTFSGFSLSTSGMGVGWIRQPPGKALEWLAHIWWDDVKRYSPSLKSRLTITKDTSKNQVVLTMTNMDPVDTATYYCARIVSFDNDVVSAMDYWGQGTLVTVSS

SEQ ID NO: 4316 - protein, 118 aa, Artificial Sequence
  Synthetic Polypeptide
QVQLVQSGAEVKKPGASVKVSCKASGYTFTNYGMNWVRQAPGQGLEWMGWINTYTGEPTYADDFKGRVTMTTDTSTSTAYMELRSLRSDDTAVYYCARIGDSSPSDYWGQGTLVTVSS

SEQ ID NO: 4317 - protein, 115 aa, Artificial Sequence
  Synthetic Polypeptide
EVQLLESGGGLVQPGGSLRLSCAASGFTFSGYAMSWVRQAPGKGLEWVSEIAPPGLNTRYADSVKGRFTISRDNSKNTLYLQMNSLRAEDTAVYYCAKSDTAFDYWGQGTLVTVS

SEQ ID NO: 4318 - protein, 119 aa, Artificial Sequence
  Synthetic Polypeptide
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 4319 - protein, 123 aa, Artificial Sequence [sequence omitted]

SEQ ID NO: 4320 - protein, 116 aa, Artificial Sequence
  Synthetic Polypeptide
EVQVLESGGGLVQPGGSLRLSCAASGFTFSSYAMSWVRQAPGKGLEWVSAISGSGGSTNYADSVKGRFTISRDNSKNTLYLQMNSLRAEDTAVYYCAGSSGWSEYWGQGTLVTVSS

SEQ ID NO: 4321 - protein, 114 aa, Artificial Sequence
  Synthetic Polypeptide
EIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSS

SEQ ID NO: 4322 - protein, 127 aa, Artificial Sequence
  Synthetic Polypeptide
EVQLLESGGGVVQPGRSLRLSCAASGFTFSSYGMHWVRQAPGKGLEWVAVISYDGSNKYYADSVKGRFTISRDNSKNTLYLQMNSLRAEDTAVYYCAKDMGWGSGWRPYYYYGMDVWGQGTTVTVSS

SEQ ID NO: 4323 - protein, 120 aa, Artificial Sequence
  Synthetic Polypeptide
EVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSS

SEQ ID NO: 4324 - protein, 117 aa, Artificial Sequence
  Synthetic Polypeptide
EVKLDETGGGLVQPGRPMKLSCVASGFTFSDYWMNWVRQSPEKGLEWVAQIRNKPYNYETYYSDSVKGRFTISRDDSKSSVYLQMNNLRVEDMGIYYCTGSYYGMDYWGQGTSVTVS

SEQ ID NO: 4325 - protein, 118 aa, Artificial Sequence
  Synthetic Polypeptide
GVKLDETGGGLVQPGGAMKLSCVTSGFTFGHYWMNWVRQSPEKGLEWVAQFRNKPYNYETYYSDSVKGRFTISRDDSKSSVYLQMNNLRVEDTGIYYCTGASYGMEYLGQGTSVTVST

SEQ ID NO: 4326 - protein, 126 aa, Artificial Sequence [sequence omitted]

SEQ ID NO: 4327 - protein, 124 aa, Artificial Sequence
  Synthetic Polypeptide
VHEVQLVQSGAEVKKPGSSVKVSCKASGGTFSSYAISWVRQAPGQGLEWMGGIIPIFGTANYAQKFQGRVTITADKSTSTAYMELSSLRSEDTAVYYCATFALFGFREQAFDIWGQGTTVTVSS

SEQ ID NO: 4328 - protein, 122 aa, Artificial Sequence [sequence omitted]

SEQ ID NO: 4329 - protein, 118 aa, Artificial Sequence
  Synthetic Polypeptide
QVQLVQSGAEVVKPGASVKISCKASGYTFTGYFMNWVKQSPGQSLEWIGRIHPYDGDTFYNQKFQGKATLTVDKSSNTAHMELLSLTSEDFAVYYCTRYDGSRAMDYWGQGTTVTVSS

SEQ ID NO: 4330 - protein, 124 aa, Artificial Sequence
  Synthetic Polypeptide
QVQLVQSGAEVKKPGASVKVSCKASGYTFTTYGISWVRQAPGQGLEWMGWISAYNGHTNYAQMLQGRVTMTTDTSTSTAYMELRGLRSDDTAVYYCAREAYASYGSGSYWTDYWGQGTLVTVSS

SEQ ID NO: 4331 - protein, 113 aa, Artificial Sequence
  Synthetic Polypeptide
EVQLVQSGAEVEKPGASVKISCKASGSSFTGYNMNWVRQNIGKSLEWIGAIDPYYGGTSYNQKFKGRATLTVDKSTSTAYMHLKSLRSEDTAVYYCVSGMEYWGQGTSVTVSS

SEQ ID NO: 4332 - protein, 121 aa, Artificial Sequence
  Synthetic Polypeptide
QVQLVESGPGVVQPGRSLRISCAVSGFSVTNYGVHWVRQPPGKGLEWLGVIWAGGITNYNSAFMSRLTISKDNSKNTVYLQMNSLRAEDTAMYYCASRGGHYGYALDYWGQGTLVTVSSTR

SEQ ID NO: 4333 - protein, 119 aa, Artificial Sequence
  Synthetic Polypeptide
EVTLVESGGDFVKPGGSLKVSCAASGFAFSHYAMSWVRQTPAKRLEWVAYISSGGSGTYYSDSVKGRFTISRDNAKNTLYLQMRSLRSEDSAMYFCTRVKLGTYYFDSWGQGTTLTVSS

SEQ ID NO: 4334 - protein, 123 aa, Artificial Sequence
  Synthetic Polypeptide
QSVKESEGGLFKPTDTLTLTCTVSGFSLSRHALTWVRQAPGNGLEWIGAIDNAGTTYYASWAKSRSTITRNTDLHTVTLKMTSLTASDTATYFCARVFYDINSGYYLDGMDLWGPGTLVTVSS

SEQ ID NO: 4335 - protein, 118 aa, Artificial Sequence
  Synthetic Polypeptide
EQLKESGGGLFKPTDTLTLTCTVSGFSLSYYGVNWVRQAPGNGLEWIGTIGGSGDTYYASWAKSRSTIIRNTNENTVTLKMTSLTAADTATYFCVRYANIGYEYFNVWGPGTLVTVSS

SEQ ID NO: 4336 - protein, 121 aa, Artificial Sequence
  Synthetic Polypeptide
EVQLVESGGGLVQPGESLRLSCVASGFTFSRYKMNWVRQAPGKGLEWVSYISRSGRDIYYADSVKGRFTISRDNAKNSLYLQMNSLRDEDTAVYYCAGTVTTYYYFGMDVWGHGTTVTVSS

SEQ ID NO: 4337 - protein, 122 aa, Artificial Sequence
  Synthetic Polypeptide
EVQLVESGGGSVQPGESLRLSCVASGFTFSRYKMNWVRQAPGKGLEWVSYISRSGRDIYYADSVKGRFTISRDNAKNSLYLQMNSLRDEDTAVYYCAGTVTTYYYDFGMDVWGQGTTVTVSS

SEQ ID NO: 4338 - protein, 124 aa, Artificial Sequence
  Synthetic Polypeptide
EVQLVQSGGGSLTLSCAASGVVQPGRFTFSSYGMHWVRQAPGKGLEWVSVISYDGSNKYYADSVKGRFTISRDNSKNTLYLQMNSLRTEDTAVYYCAKTLSAGEWIGGGAFDIWGHGTMVTVSS

SEQ ID NO: 4339 - protein, 119 aa, Artificial Sequence
  Synthetic Polypeptide
QVKLQESGGGLVKPGGSLKLSCAASGFTFSSYGMSWVRQTPDKRLEWVATISSGGSYTYYPDSVKGRFTISRDNAKNTLYLQMSSLKSEDTAMYYCARGNWEGWYFDVWGQGTTVTVSS

SEQ ID NO: 4340 - protein, 115 aa, Artificial Sequence
  Synthetic Polypeptide
QVQLQQSGAELVRPGASVKLSCKASGYTFNDYEMHWVKQTPVHGLKWIGALEPKTGDTAYSQKFKGKATLTADKSSSTAYMELRSLTSEDSAVYYCTSCYYYTYSGQGTLVTVSA

SEQ ID NO: 4341 - protein, 119 aa, Artificial Sequence [sequence omitted]

SEQ ID NO: 4342 - protein, 116 aa, Artificial Sequence
  Synthetic Polypeptide
EVQLVESGGGLIQPGGSLRLSCAASGFTFSNYAMNWVRQAPGKGLEWVSTINGRGSSTIYADSVKGRFTISRDNSKNTLYLQMNSLRAEDTATYYCARYISRGLGDSWGQGTLVTV

SEQ ID NO: 4343 - protein, 117 aa, Artificial Sequence
  Synthetic Polypeptide
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARGYGKAYDQWGQGTLVTVSS

SEQ ID NO: 4344 - protein, 114 aa, Artificial Sequence
  Synthetic Polypeptide
EVQLVETGGNLVQPGASLRLSCAASGFSFSGTAMHWVRQAPGKGLEWVSTISSTGRSTYYRDSVKGRFTISRDNSKNTLYLQMNSLRGEDTAVYYCARVSFDYWGQGTLVTVSS

SEQ ID NO: 4345 - protein, 118 aa, Artificial Sequence
  Synthetic Polypeptide
EVQLVESGGAFVQPGGSLRLSCAASGFTFSSYAMTWVRQAPGKGLEWVSTISGRGRSTFYADSVKGRFTISRDNSKNTLYLQMNSLRAEDTAVYYCARYYHAGAFDLWGQGTLVTVSS

SEQ ID NO: 4346 - protein, 120 aa, Artificial Sequence
  Synthetic Polypeptide
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDVWGQGTLVTVSS

SEQ ID NO: 4347 - protein, 129 aa, Artificial Sequence
  Synthetic Polypeptide
QVQLLQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTQVTVSSASTKGP

SEQ ID NO: 4348 - protein, 118 aa, Artificial Sequence
  Synthetic Polypeptide
EVQLVETGGGLVQPGESLRLSCAASGFTFSDYEMNWVRQAPGKGLEWVSYISSSGSTIYYADSVKGRFTIYRDNAKNSLYLQMNSLRAEDTALYYCARAWGVGPPDYWGQGTLVTVSS

SEQ ID NO: 4349 - protein, 135 aa, Artificial Sequence
  Synthetic Polypeptide
QPQLQESGPTLVEASETLSLTCAVSGDSTAACNSFWGWVRQPPGKGLEWVGSLSHCASYWNRGWTYHNPSLKSRLTLALDTPKNLVFLKLNSVTAADTATYYCARFGGEVLRYTDWPKPAWVDLWGRGTLVTVSS

SEQ ID NO: 4350 - protein, 121 aa, Artificial Sequence
  Synthetic Polypeptide
QVQLVQSGGQMKKPGESMRISCRASGYEFIDCTLNWIRLAPGKRPEWMGWLKPRGGAVNYARPLQGRVTMTRDVYSDTAFLELRSLTVDDTAVYFCTRGKNCDYNWDFEHWGRGTPVIVSS

SEQ ID NO: 4351 - protein, 128 aa, Artificial Sequence
  Synthetic Polypeptide
LEQSGAEVKKPGSSVQVSCKASGGTFSMYGFNWVRQAPGHGLEWMGGIIPIFGTSNYAQKFRGRVTFTADQATSTAYMELTNLRSDDTAVYYCARDFGPDWEDGDSYDGSGRGFFDFWGQGTLVTVSS

SEQ ID NO: 4352 - protein, 123 aa, Artificial Sequence
  Synthetic Polypeptide
QVQLVQSGGGVVQPGGSLRVSCAASGVTLSDYGMHWVRQAPGKGLEWVAFIRNDGSDKYYADSVKGRFTISRDNSEKTVSLQMSSLRAEDTAVYYCAKNGESGPLDYWYLDLWGRGTLVTVSS

SEQ ID NO: 4353 - protein, 122 aa, Artificial Sequence
  Synthetic Polypeptide
EVQVEVSGGGLVQPGGSMRLSCAVSGFTFSNYWMNWVRQSPEKGLEWIAEIRLKSNNFARYYAESVKGRFTISRDNSKNSLYLQMISLRAEDTAIYYCTSYGNYVGHYFDHWGQGTLLTVSS

SEQ ID NO: 4354 - protein, 122 aa, Artificial Sequence
  Synthetic Polypeptide
LEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARAPQSWYVGDVWGQGTLVTVSS

SEQ ID NO: 4355 - protein, 122 aa, Artificial Sequence
  Synthetic Polypeptide
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGVYGYSGSAPYDEWGQGTLVTVSS

SEQ ID NO: 4356 - protein, 122 aa, Artificial Sequence
  Synthetic Polypeptide
EVQLVQSGAEVSVKVSCKASGGKKPGSTFSSYTISWVRQAPGQGLEWMGGIIPIFGTANYAQKFQGRVTITADKSTSTAYMELSSLRSEDTAVYYCAGDTDSSGYYGAVDYWGQGTLVTVSS

SEQ ID NO: 4357 - protein, 124 aa, Artificial Sequence
  Synthetic Polypeptide
QVQLVQSGGGVVQPGRSLRLSCAASGFTFSSYGMHWVRQAPGKGLEWVAVISYDGSNKYYADSVKGRFTISRDNSKNTLYLQMNSLRAEDTAVYYCARDFDYGDSYYYYGMDVWGQGTTVTVSS

SEQ ID NO: 4358 - protein, 118 aa, Artificial Sequence
  Synthetic Polypeptide
EVQLLESGGGLVQPGGSLRLSCAASGFTFSWYSMTWVRQAPGKGLEWVSSIVPWGDFTQYADSVKGRFTISRDNSKNTLYLQMNSLRAEDTAVYYCAKGPGWGSFDLWGRGTLVTVSS

SEQ ID NO: 4359 - protein, 116 aa, Artificial Sequence
  Synthetic Polypeptide
EVQLVESGGGLVQPGGSLRLSCAASGFSLTKYGVHWVRQAPGKGLEWVGVKWAGGSTDYNSALMSRFTISKDNAKNSLYLQMNSLRAEDTAVYYCARDHRDAMDYWGQGTLVTVSS

SEQ ID NO: 4360 - protein, 122 aa, Artificial Sequence
  Synthetic Polypeptide
EVQLVESGGGLVQPGGSLRLSCAASGFTFSRNGMSWVRQAPGKGLEWVATVSSGGSYIYYADSVKGRFTISRDNAKNSLYLQMNSLRAEDTAVYYCARQGTTALATRFFDVWGQGTLVTVSS

SEQ ID NO: 4361 - protein, 107 aa, Artificial Sequence
  Synthetic Polypeptide
DIQMTQSPSSLSASVGDSVTITCQASQDISSYLNWYQQKPGKAPELLIYYGSELESGVPSRFSGSGSGTDFTFTISSLEAEDAATYYCGQGNRLPYTFGQGTKVEIE

SEQ ID NO: 4362 - protein, 128 aa, Artificial Sequence
  Synthetic Polypeptide
QVQLQQSGPGLVKPSQTLSLTCAISGDSVSSYNAVWNWIRQSPSRGLEWLGRTYYRSGWYNDYAESVKSRITINPDTSKNQFSLQLNSVTPEDTAVYYCARSGHITVFGVNVDAFDMWGQGTMVTVSS

SEQ ID NO: 4363 - protein, 121 aa, Artificial Sequence
  Synthetic Polypeptide
EVQLQQSGTVLARPGTSVKMSCRASGYSFTTFWMHWVKQRPGQGPEWIGAIYPENSDTRYNPTFKDKAELTAVTSANTVYMELSSLTDEDSAVYYCTRPSLYAMDYWGQGTSVTVSSAKTT

SEQ ID NO: 4364 - protein, 122 aa, Artificial Sequence; identical to SEQ ID NO: 4304
  Synthetic Polypeptide

SEQ ID NO: 4365 - protein, 117 aa, Artificial Sequence
  Synthetic Polypeptide
EVQLVQSGGGLVQSGGSLRLSCRASGYTFTRYWMLWVRQRPGKGLEWVAEINPRNDRTNYNEKFKTRFTISVDRSKNTLYLQMDSLRAEDTAVYFCALGGGYAMDYWGQGTLVTVSS

SEQ ID NO: 4366 - protein, 118 aa, Artificial Sequence
  Synthetic Polypeptide
QVQLVQSGAELVKPGASVKMSCKASGYIFTNYNIHWVKKSPGQGLEWIGAIYPGNGDAPYSQKFQDRATLTADTSSSTTYMELSSLTSEDSAVYYCVRANWDVAFAYWGQGTLVSVSS

SEQ ID NO: 4367 - protein, 119 aa, Artificial Sequence
  Synthetic Polypeptide
QVQLQQSGASVKVSCKASELVRPGTGYAFTNYLIEWVKQRPGQGLEWIGVINPGSGGTNYNEKFKGKATLTADKSSSTAYMQLSSLTSDDSAVYFCARYRSYDWYFDVWGAGTTVTVSS

SEQ ID NO: 4368 - protein, 118 aa, Artificial Sequence
  Synthetic Polypeptide
EVQLVESGGGVVQPGRSLRLSCSSSGPTFSDYYMYWVRQAPGKGLEWVAYMSNVGAITDYPDTVKGRPTISRDNSKNTLFLMDSLRPEDTGVYFCARGTRDGSWFAYWGQGTPVTVSS

SEQ ID NO: 4369 - protein, 119 aa, Artificial Sequence
  Synthetic Polypeptide
QVQLKESGPGLVAPSQSLSITCTISGFSLTSYGVHWVRQPPGKGLEWLVVIWSDGSTTYNSALKSRLSISKDNSKSQVFLKMNSLQTDDTAIYYCASHYGSTLAFASWGHGTLVTVSAA

SEQ ID NO: 4370 - protein, 127 aa, Artificial Sequence
  Synthetic Polypeptide
EVQLEESGGGLVQPGGSMKLSCVASGFTFSNYWMNWVRQSPEKGLEWVAEIRFKSHNYATHFAESVKGRFTISRDDSKSSVYLQMNNLRAEDTGIYYCTRRIGNSDYDWWYFDVWGAGTSVTVSSAS

SEQ ID NO: 4371 - protein, 120 aa, Artificial Sequence
  Synthetic Polypeptide
EVQLQQSGAEVKKPGSSVKVSCKASGGTFSSYAISWVRQAPGQGLEWMGRIIPILGIANYAQKFQGRVTITADKSTSTAYMELSSLRSEDTAVYYCARDVGSGSYSLDYWGQGTLVTVSS

SEQ ID NO: 4372 - protein, 118 aa, Artificial Sequence
  Synthetic Polypeptide
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARHVGHELDYWGQGTLVTVSS

SEQ ID NO: 4373 - protein, 119 aa, Artificial Sequence
  Synthetic Polypeptide
QVQLQESGPGLVKPSETLSLTCTVSGGSVSSGSYYWSWIRQPPGKGLEWIGYIYYSGSTNYNPSLKSRVTISVDTSKNQFSLKLSSVTAADTAVYYCAREGKNGAFDIWGQGTMVTVSS

SEQ ID NO: 4374 - protein, 119 aa, Artificial Sequence; identical to SEQ ID NO: 4373
  Synthetic Polypeptide

SEQ ID NO: 4375 - protein, 118 aa, Artificial Sequence
  Synthetic Polypeptide
DVQLQESGPGLVKPSQSLSLTCTVTGYSITIDYTWNWIRQFPGNKLEWMGYITYSGSTDYNPSLKSRSSITRDTSMNQFFLQLNSVTTEDTATYYCARLGRRYALDYWGQGTSVTVSS

SEQ ID NO: 4376 - protein, 118 aa, Artificial Sequence
  Synthetic Polypeptide
DVQLQESGPGLVKPSQSLSLTCTVTGYSITSDYTWNWIRQFPGNKLEWMGYITYSGSTSYNPSLKSRNSITRDTSKNQFFLQLNSVTTEDTATYYCARLGRRYTMDYWGQGTSVTVSS

SEQ ID NO: 4377 - protein, 118 aa, Artificial Sequence; identical to SEQ ID NO: 4376
  Synthetic Polypeptide

SEQ ID NO: 4378 - protein, 120 aa, Artificial Sequence
  Synthetic Polypeptide
EVQLVESGGGLVQPKGSLKLSCAASGFSFNTYAMNWVRQAPGKGLEWIAHIRSKSNNFATYYADSVKDRFSISRDASENILFLQMNNLKTEDTAMYYCVRQGGDFPMDYWGQGTSVTVSS

SEQ ID NO: 4379 - protein, 115 aa, Artificial Sequence
  Synthetic Polypeptide
QVQLQQSGPELVKPGASVKMSCKASGYAFSSSWLNWVRQRPGKGLEWIGRIYPGDGENHYNGKFKGKATLTADKSSSTGYMQLSSLTSEDSAVYFCASYYEGGYWGQGTLITVSA

SEQ ID NO: 4380 - protein, 118 aa, Artificial Sequence
  Synthetic Polypeptide
QVQLVQSGPEVKKPGASVKVSCKASGYTFTNSWMNWVRQRPGKGLEWIGRIYPGDGETIYNGKFRVRVTITADESTSTAYMELSSLRSEDTAVYYCARGYDDYSFAYWGQGTTVTVSS

SEQ ID NO: 4381 - protein, 113 aa, Artificial Sequence
  Synthetic Polypeptide
QVQLQQSGPGLVKPSETLSLTCTVSGDSISSYYWSWIRQPPGKGLEWIGYIYYSGSTNYNPSLKSRVTISVDTSKSQFSLKLSSVTAADTAVYYCARGRYFDVWGRGTMVTSS

SEQ ID NO: 4382 - protein, 115 aa, Artificial Sequence
  Synthetic Polypeptide
EVKLVESGGGLVKPGGSRKLSCAASGFTFSSYTMSWVRQTPAKRLEWVATISSGSSTIYYADTVKGRFTISRDNAKNTLFLQMTSLRSEDTAMYYCARRWFLDCWGQGTTLTVSS

SEQ ID NO: 4383 - protein, 123 aa, Artificial Sequence
  Synthetic Polypeptide
EVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGPEYCINGVCSLDVWGQGTTVTVSS

SEQ ID NO: 4384 - protein, 121 aa, Artificial Sequence
  Synthetic Polypeptide
EVQLVQSGAEVKKPGSSVKVSCKASGGTFSSYAISWVRQAPGQGLEWMGGIIPIFGTANYAQKFQGRVTITADESTSTAYMELSSLRSEDTAVYYCAVHYGDYVFSSMDVWGQGTTVTVSS

SEQ ID NO: 4385 - protein, 122 aa, Artificial Sequence
  Synthetic Polypeptide
VKLQESGGGFVKPGGSLKVSCAASGFTFSSYAMSWVRLSPEMRLEWVATISSAGGYIFYSDSVQGRFTISRDNAKNTLHLQMGSLRSGDTAMYYCARQGFGNYGDYYAMDYWGQGTTVTVSS

SEQ ID NO: 4386 - protein, 115 aa, Artificial Sequence
  Synthetic Polypeptide
QVHLQESGPGLVKPSETLSLTCTVSDDSISSYYWSWIRQPPGKGLEWIGHISYSGSANYNPSLKSRVTISVDTSKNQFSLKLSSVTAADTAVYYCANWDDAFNIWGQGTMVTVSS

SEQ ID NO: 4387 - protein, 114 aa, Artificial Sequence
  Synthetic Polypeptide
VQLQESGPDLVKPSQSLSLTCTVTGYSITSGYSWHWIRQFPGNKLEWMGYIHYSGDTDYNPSLKSRFSITRDTSKNQFFLQLNSVTTEDTATYYCATPGGFVYWGQGTLVTVSS

SEQ ID NO: 4388 - protein, 118 aa, Artificial Sequence
  Synthetic Polypeptide
VQLLESGGGLVQPGGSLRLSCAASGFTFSTYQMSWVRQAPGKGLEWVSGIVSSGGSTAYADSVKGRFTISRDNSKNTLYLQMNSLRAEDTAVYYCAGELLPYYGMDVWGQGTTVTVSS

SEQ ID NO: 4389 - protein, 119 aa, Artificial Sequence
  Synthetic Polypeptide
EVQLLESGGGLVQPGGSLRLSCAASGFTFSTYEMHWVRQAPGKGLEWVSVILSSGGETNYADSVKGRFTISRDNSKNTLYLQMNSLRAEDTAVYYCAGMLLPYYGMDVWGQGTTVTVSS

SEQ ID NO: 4390 - protein, 113 aa, Artificial Sequence
  Synthetic Polypeptide
QVYLVESGGGVVQPGRSLRLSCAASGFTFSNYGMHWVRQAPGKGLEWVALIWYDGSNKYYADSVKGRFTISRDNSKNTLYLQMTSLRVEDTAVYYCASNVDHWGQGTLVTVSS

SEQ ID NO: 4391 - protein, 110 aa, Artificial Sequence
  Synthetic Polypeptide
QVQLVESGGGWQPGRSLRLDCKASGITFSNSGMHWVRQAPGKGLEWVAVIYDGSKRYYADSVKGRFISRDNSKNTLFLQMNSLRAEDTAVYYCATNDDYWGQGTLVTVSS

SEQ ID NO: 4392 - protein, 118 aa, Artificial Sequence [sequence omitted]

SEQ ID NO: 4393 - protein, 115 aa, Artificial Sequence
  Synthetic Polypeptide
QSLEESGGRLVKPDETLTITCTVSGIDLSSNGLTWVRQAPGEGLEWIGTINKDASAYYASWAKGRLTISKPSSTKVDLKITSPTTEDTATYFCGRIAFKTGTSIWGPGTLVTVSS

SEQ ID NO: 4394 - protein, 107 aa, Artificial Sequence
  Synthetic Polypeptide
EVKLEESGGDLVKPGGSLKLSCAASGFTFSGYGMSWVRQTPDKRLEWVATISSGGSYTYYPDSVKGRFTISRDNAKNTLYLQMSSLKSEDTAMYYCARHEGGYYGSS

SEQ ID NO: 4395 - protein, 134 aa, Artificial Sequence
  Synthetic Polypeptide
VAAPRWVLSQVQLQESGPGLVKPSQTLSLTCTVSGGSISSGGYYWIWIRQHPGKGLEWIGYIYYNGNTYYNPSLKSRVTMSVDTSKNQFSLKLSSVTAADTAVYYCARDGITMIRGYYYGMDVWGQGTTVTVSS

SEQ ID NO: 4396 - protein, 130 aa, Artificial Sequence
  Synthetic Polypeptide
GLQCVAAPRWVLSQVQLQQWGAGLLKPSETLSLTCAVYGGSFSGNYWSWIRQPPGKGLEWIGEINHSGSTNYNPSLKSRVTISVDTSKNQFSLKLSSVTAADTAVYYCARGGSYNYFDYWGQGTLVTVSS

SEQ ID NO: 4397 - protein, 123 aa, Artificial Sequence
  Synthetic Polypeptide
QVQLVESGGGVVQPGRSLRLSCAASGFAFSRYGMHWVRQAPGKGLEWVAVIWYDGSNKYYADSVKGRFTISRDNSKNTQYLQMNSLRAEDTAVYYCARGGDFLYYYYYGMDVWGQGTTVTVSS

SEQ ID NO: 4398 - protein, 115 aa, Artificial Sequence
  Synthetic Polypeptide
EVQLVQSGPEVKKPGATVKISCKTSGYTFTEYTIHWVKQAPGKGLEWIGNINPNNGGTTYNQKFEDKATLTVDKSTDTAYMELSSLRSEDTAVYYCAAGWNFDYWGQGTLLTVSS

SEQ ID NO: 4399 - protein, 120 aa, Artificial Sequence
  Synthetic Polypeptide
QITLKESGPTLVKPTQTLTLTCTFSGFSLSTSNMGVGWIRQPPGKALEWLAHIWWDDDKYYSPSLKSRLTITKDTSKNQVVLTMTNMDPVDTATYYCVRSNYGYAWFAYWGQGTLVTVSS

SEQ ID NO: 4400 - protein, 115 aa, Artificial Sequence
  Synthetic Polypeptide
QVQLQQSGAELVRPGVSVKISCKGSGYRFTDYPIHWVKQSHAKSLEWIGIISTYYGDVTNNPKFRGKATMTVDKSSTTAYMELARLTSEDSAIYYCARNDLFAYWGQGTLVTVSA

SEQ ID NO: 4401 - protein, 119 aa, Artificial Sequence
  Synthetic Polypeptide
EVKLVESGGGLVKPGGSLKLSCAASGFTFSSYAMSWVRQIPEKRLEWVASISRGGTTYYPDSVKGRFTISRDNVRNILYLQMSSLRSEDTAMYYCGRYDYDGYYAMDYWGQGTSVTVSS

SEQ ID NO: 4402 - protein, 120 aa, Artificial Sequence
  Synthetic Polypeptide
EVKLQESGPELVKPGASVKMSCKASGYTFTSYVMHWVKQKPGQGLEWIGYINPYNDGTKYNEKFKGKATLTSDKSSSTAYMELSSLTSEDSAVYYCARWKIYYGNYEDYWGQGTPLTVSS

SEQ ID NO: 4403 - protein, 123 aa, Artificial Sequence
  Synthetic Polypeptide
QVQLVESGGGSVQPGRSLRLSCEASGFTFEAYAMHWVRQPPGKGLEWVSSINWNSGRIAYADSVKGRFTISRDNARNSLYLQMNSLRLEDTAFYYCAKDIRRFSTGGAEFEYWGQGTLVTVSS

SEQ ID NO: 4404 - protein, 126 aa, Artificial Sequence
  Synthetic Polypeptide
QVQLLESGGGVVQPGRSLRLSCAASGFTFSFYGMHWVRQAPGKGLEWVAAISYDGSNKYYADSVKGRFTISRDNSKNTLYLQMNSLRAEDTAVYYCAKRPNQFYCSDGRCYSIDYWGQGTLVTVSS

SEQ ID NO: 4405 - protein, 119 aa, Artificial Sequence
  Synthetic Polypeptide
QVQLKESGPGLVAPSQSLSITCTVSGFSLSSQGVYWVRQPPGKGLEWLGAIWAGGSTNYNSALMSRLSISKDNSKSQVFLKMNSLQTDDTAMYYCARVDGYRGYNMDYWGQGTSVTVSS

SEQ ID NO: 4406 - protein, 120 aa, Artificial Sequence
  Synthetic Polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARAHNSSSWSFDYWGQGTLVTVSS

SEQ ID NO: 4407 - protein, 124 aa, Artificial Sequence
  Synthetic Polypeptide
EVRLQQSGPDLIKPGASVKMSCKASGYTFTGYVMHWVKQRPGQGLEWIGFINPYNDDIQSNERFRGKATLTSDKSSTTAYMELSSLTSEDSAVYYCARGAGYNFDGAYRFFDFWGQGTTLTVSS

SEQ ID NO: 4408 - protein, 119 aa, Artificial Sequence
  Synthetic Polypeptide
QVQLVESGAEVKKPGASVKVSCKASGYTFTGYYMHWVRQAPGQGLEWMGRINPNSGGTNYAQKFQGRVTMTRDTSISTAYMELSRLRSDDTAVYYCASPRGRGSAFDIWGQGTLVTVSS

SEQ ID NO: 4409 - protein, 118 aa, Artificial Sequence
  Synthetic Polypeptide
EVQLVESGGGVVQPGGSLRLSCAASGFTFSSYAMSWVRQAPGKGLEWVSAISGSGGSTYYADSVKGRFSISRDNSKNTLYLQMNSLRAEDTAVYYCARTRSSGAFDIWGQGTLVTVSS

SEQ ID NO: 4410 - protein, 119 aa, Artificial Sequence
  Synthetic Polypeptide
EVQLQQSGPELVKPGASVKISCKASGYSFTGYFMNWVKQSHGKSLEYIGRFNPYNGETLYNQKFKGKATLTVDKSSSTVHMELLSVTSEDSAVYYCGRSGNDDAMDYWGQGTSVTVSSA

SEQ ID NO: 4411 - protein, 123 aa, Artificial Sequence
  Synthetic Polypeptide
QVQLVQSGGGVVQPGRSLRLSCAASGFTFSSYAMHWVRQAPGKGLEWVAVISYDGSNKYYADSVKGRFTISRDNSKNTLYLQMNSLRAEDTAVYYCARELRFLEWSSDAFDIWGQGTMVTVSS

SEQ ID NO: 4412 - protein, 119 aa, Artificial Sequence
  Synthetic Polypeptide
QVQLVQSGAEVKKPGSSVKVSCKASGGTFSSYAISWVRQAPGQGLEWMGWINVGNGNAIYSQKFQGRVTITRDTSATTAYMELSSLRSEDTAVYYCARDGERAWDLDYWGQGTLVTVSS

SEQ ID NO: 4413 - protein, 118 aa, Artificial Sequence
  Synthetic Polypeptide
QVQLVQSGAEVRKPGSSVKVSCKASGGSFNNYPIFWVRQAPGQGFEWMGRIIPILGITAYAQKFQGRVTITADKSTSTAYMELNSLRSEDTAVYYCAGGDDLDAFDIWGQGTMVSVSS

SEQ ID NO: 4414 - protein, 121 aa, Artificial Sequence
  Synthetic Polypeptide
QLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPTMIRGVIDSWGQGTLVTVSS

SEQ ID NO: 4415 - protein, 123 aa, Artificial Sequence
  Synthetic Polypeptide
QVQLVESGGGVVQPGRSLRLSCAASGFIFSRYGMHWVRQAPGKGLKWVAVIWYDGSNKLYADSVKGRFTISRDNSKNTLYLQMNSLRAEDTAVYYCARDYYDNSRHHWGFDYWGQGTLVTVSS

SEQ ID NO: 4416 - protein, 120 aa, Artificial Sequence
  Synthetic Polypeptide
QVQLQQSGAELVRPGTSVKVSCKASGYVFTNYWIEWIKQRPGQGLEWIGVMNPGSGETTYNEKFKGKATLTADKSSSTAYMQLSSLTSVDSAVYFCARDHDRDYYAMDYWGQGTSVTVSS

SEQ ID NO: 4417 - protein, 116 aa, Artificial Sequence
  Synthetic Polypeptide
QVQLQQSDAELVKPGASVKISCKASGYTFTDHAIHWVKQKPEQGLEWIGYFSPGNGDIKYNEKFKGKATLTADKSSSTAYMQLNSLTSEDSAVYFCKRSYGNYDYWGQGTTLTVSS

SEQ ID NO: 4418 - protein, 116 aa, Artificial Sequence
  Synthetic Polypeptide
QVQLVQSGAEVKKTGSSVKVSCKASGYTFTDHAIHVWRQAPGQALEWMGHFSPGNTDIKYNDKFKGRVTLTVDRSMSTAYMELSSLRSEDTAMYYCKTSTFFFDYWGQGTMVTVSS

SEQ ID NO: 4419 - protein, 121 aa, Artificial Sequence
  Synthetic Polypeptide
QIQLVQSGHEVKKPGASVKVSCKASGYTFTNYGMNWVRQAPGQGLEWMGWINTKTGEPTYAEEFKGRFVFSLETSASTAYLQISSLKAEDTAMYFCGRGGYGSSYWYFDVWGQGTTVTVSS

SEQ ID NO: 4420 - protein, 119 aa, Artificial Sequence
  Synthetic Polypeptide
QVQLQESGPGLVKPSETLSLTCTVSGGSISSYGVHWIRQPPGKGLEWIGVIWTSGVTDYNSALMGRVTISVDTSKNQFSLKLSSVTAADTAVYYCARDGDYDRYTMDYWGQGTLVTVSS

SEQ ID NO: 4421 - protein, 126 aa, Artificial Sequence
  Synthetic Polypeptide
EVQLVESGGGLIQPGGSLRLSCAASGFTVSSNYMSWVRQAPGKGLEWVSVTYSGGSTSYADSVKGRFTISRDNSKNTLYLQMNSLRAEDTAVYYCARGGRYCSSISCYARSGCDYWGQGTLVTVSS

SEQ ID NO: 4422 - protein, 119 aa, Artificial Sequence
  Synthetic Polypeptide
QVQLVQSGAEVKKPGQSLKISCKASGYSLTDNWIGWVRQKPGKGLEWMGIIYPGDSDTRYSPSFQGQVTISADKSINTAYLQWSSLKASDTAIYYCVGLDWNYNPLRYWGPGTLVTVSS

SEQ ID NO: 4423 - protein, 117 aa, Artificial Sequence
  Synthetic Polypeptide
EVQLQQSGPELVKPGASMKISCKASGYSFSAYTMNWVKQSHGKNLEWIGLINPYNGGTNYNQEFEGKATLTVNKSSNTAFMELLSLTSDDSAVYYCARRDWDYFDYWGQGTTLTVSS

SEQ ID NO: 4424 - protein, 122 aa, Artificial Sequence
  Synthetic Polypeptide
QVQLVESGGGLVKPGGSLRLSCAASGFSITTSGYYWTWIRQFPGKGLEWMGYIGYNSKTYYNPALKSRITISRDNAKNSLYLQMNSLRAEDTAVYYCARSLYGGYKDAFDSWGQGTLVTVSS

SEQ ID NO: 4425 - protein, 121 aa, Artificial Sequence
  Synthetic Polypeptide
EVQLVESGGGVVQPGRSLRLSCAASGFTFRSYGMHWVRQAPGKGLEWVAVISYDGSNKYYTDSVNGRFTISRDNSKNTLYLQMNSLRAEDTAVYYCARGGGYYETSGPDYWGQGTLVTVSS

SEQ ID NO: 4426 - protein, 119 aa, Artificial Sequence
  Synthetic Polypeptide
QLQLQESGPGLVKPSGTLSLTCAVSGGSISSSNWWSWVRQPPGKGLEWIGEIYHSGSTNYNPSLKSRVTISVDKSKNQFSLKLSSVTAADTAVYYCVGSPYGDYVLDYWGQGTLVTVSS

SEQ ID NO: 4427 - protein, 123 aa, Artificial Sequence
  Synthetic Polypeptide
EVQLVETGGGVVQPGRSLRLSCAASGFTFSSYGMHWVRQAPGKGLEWVAVISYDGSNKYYADSVKGRFTISRDNSKNTLYLQMNSLRAEDTAVYYCAKDRYGWGSSFGHFDYWGQGTLVTVSS

SEQ ID NO: 4428 - protein, 123 aa, Artificial Sequence
  Synthetic Polypeptide
QVQLQQSGPGLVKPSQTLSLTCAISGDSVSGNSATWNWIRQSPSRGLEWLGRTYYRSKWNHDYAESVKSRITINPDTSKNQFSLQLNSVTPEDTAVYYCARGDSSSWYAFDYWGQGTLVTVSS

SEQ ID NO: 4429 - protein, 121 aa, Artificial Sequence
  Synthetic Polypeptide
QMQLVQSGAEVKEPGESLRISCKGSGYSFTNFWISWVRQMPGKGLEWMGRVDPGYSYSTYSPSFQGHVTISADKSTSTAYLQWNSLKASDTAMYYCARVQYSGYYDWFDPWGQGTLVTVSS

SEQ ID NO: 4430 - protein, 118 aa, Artificial Sequence
  Synthetic Polypeptide
QVQLVQSGAEVKKPGESLKISCKGSGYNFSNKWIGWVRQLPGRGLEWIAIIYPGYSDITYSPSFQGRVTISADTSINTAYLHWHSLKASDTAMYYCVRHTALAGFDYWGLGTLVTVSS

SEQ ID NO: 4431 - protein, 119 aa, Artificial Sequence
  Synthetic Polypeptide
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARRIPPYYGMDVWGQGTTVTVSS

SEQ ID NO: 4432 - protein, 121 aa, Artificial Sequence
  Synthetic Polypeptide
EVQLVQSGGGVMRPGGSLRLSCAASGFTFDDYGMSWVRQAPGKGLEWVSGINWNGGSTGYADSVRGRFTISRDNAKNSLYLQMNSLRAEDTALYYCARERGYGYHDPHDYWGQGTLVTVSS

SEQ ID NO: 4433 - protein, 121 aa, Artificial Sequence
  Synthetic Polypeptide
EVQLVQSGGGVVRPGGSLRLSCAASGFTFDDYGMSWVRQAPGKGLEWVSGINWNGGSTGYADSVRGRFTISRDNAKNSLYLQMNSLRAEDTALYYCARERGYGYHDPHDYWGQGTLVTVSS

SEQ ID NO: 4434 - protein, 120 aa, Artificial Sequence
  Synthetic Polypeptide
DVQLVESGGGLVQPGGSRKLSCAASGFTFSSFGMHWVRQAPEKGLEWVAYISSGSSTLHYADTVKGRFTISRDNPKNTLFLQMTSLRSEDTAMYYCARWGNYPHYAMDYWGQGTSVTVSS

SEQ ID NO: 4435 - protein, 119 aa, Artificial Sequence
  Synthetic Polypeptide
QVQLVESGGGVVQPGRSLRLSCAASGFTFSSYDMHWVRQAPGKGLEWVAVISYDGTNEYYADSVKGRFTISRDTSKNTLYLQMNSLRAEDTAVYYCARERYFDWSFDYWGQGTLVSVSS

SEQ ID NO: 4436 - protein, 118 aa, Artificial Sequence
  Synthetic Polypeptide
EVQLVQSGAEVKKPGASVKVSCKASGYTFTSYAMHWVRQAPGQRLEWMGWINAGNGNTKYSQKFQGRVTITRDTSASTAYMELSSLRSEDTAVYYCARDISYGSFDYWGQGTLVTVSS

SEQ ID NO: 4437 - protein, 121 aa, Artificial Sequence
  Synthetic Polypeptide
QVKLQQSGPELVKPGASVKISCKASGYSFTGYYMHWVKQSHGNILDWIGYIYPYNGVSSYNQKFKGKATLTVDKSSSTAYMELRSLTSEDSAVYYCARERGLYQLRAMDYWGQGTSVTVSS

SEQ ID NO: 4438 - protein, 113 aa, Artificial Sequence
  Synthetic Polypeptide
EVQLQESGPDLVKPSQSLSLTCTVTGYSITSGYGWHWIRQFPGNKLEWMGYIHYSGSTTYNPSLKSRISISRDTSKNQFFLQLNSVTTEDTATYYCARSLRYWGQGTTLTVSS

SEQ ID NO: 4439 - protein, 116 aa, Artificial Sequence
  Synthetic Polypeptide
EVQLVQSGAEVKKPGASVKVSCKASGYTFTNFWIHWVRQAPGQGLEWIGEIDPSDSYTNYNQKFKGRVTITRDTSTSTAYLELSSLRSEDTAVYYCAREITTVDYWGQGTLVTVSS

SEQ ID NO: 4440 - protein, 121 aa, Artificial Sequence
  Synthetic Polypeptide
EVQLVQSGAEVKKPGASVKVSCKASGYTFTSYWIGWVRQAPGQGLEWIGDIYPGGGYTNYNEKFKGRVTITRDTSTSTAYLELSSLRSEDTAVYYCARLDGSSYRGAMDSWGQGTLVTVSS

SEQ ID NO: 4441 - protein, 121 aa, Artificial Sequence [sequence omitted]

SEQ ID NO: 4442 - protein, 118 aa, Artificial Sequence
  Synthetic Polypeptide
EVQLVESGGGLAKPGGSLRLSCAASGFRFTFNNYYMDWVRQAPGQGLEWVSRISSSGDPTWYADSVKGRFTISRENAKNTLFLQMNSLRAEDTAVYYCASLTTGSDSWGQGVLVTVSS

SEQ ID NO: 4443 - protein, 119 aa, Artificial Sequence
  Synthetic Polypeptide
QVQLQQWGAGLLKPSETLSLTCAVFGGSFSGYYWSWIRQPPGKGLEWIGEINHRGNTNDNPSLKSRVTISVDTSKNQFALKLSSVTAADTAVYYCARERGYTYGNFDHWGQGTLVTVSS

SEQ ID NO: 4444 - protein, 120 aa, Artificial Sequence
  Synthetic Polypeptide
EVQLLESGGGLVQPGGSLRLSCAASGFTFSRYAMNWVRQAPGKGLEWVSGISGSGGRTYYADSVKGRFTISRDNSKNTLYLQMNSLRAEDTAVYYCAKDRDFWSGPFDYWGQGTLVTVSS

SEQ ID NO: 4445 - protein, 124 aa, Artificial Sequence
  Synthetic Polypeptide
QVQLQESGPGLVKPSETLSLTCTVSGYTITSGYDWSWIRQPPGKGLEWIGYINYGGSTNYKPSLGSRVTISVDTSKNQFSLKLSSVTAADTAVYYCARYNEYKSYIYDWYFDFWGQGTLVTVSS

SEQ ID NO: 4446 - protein, 116 aa, Artificial Sequence
  Synthetic Polypeptide
QVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSS

SEQ ID NO: 4447 - protein, 114 aa, Artificial Sequence
  Synthetic Polypeptide
QVKLQQSGPSLVKPGASVKMSCKASGYTFTDFYMKWVKQSHGKSLEWIGDINPNIGDTFYNQKFKGKATLTVDKSSSTAYMQLNSLTSEDSAVYFCSVGYFDVWGAGTTVTVSS

SEQ ID NO: 4448 - protein, 126 aa, Artificial Sequence
  Synthetic Polypeptide
QVQLVESGGGVVQPGRSLRLSCAASGFTFSSYGMHWVRQAPGKGLEWVAVIWDDGSNKYYVDSVKGRFTISRDNSKNTLYLQMNSLRAEDTAVYYCARDDYYGSGSFNSYYGTDVWGQGTTVTVSS

SEQ ID NO: 4449 - protein, 112 aa, Artificial Sequence
  Synthetic Polypeptide
EVQLVQSGGGLVHPGGSLRLSCAGSGFTFSTYLMYWVRQAPGKTLEWVSAIGSGGDTYYADSVKGRFTISRDNAKNSLYLQMNSLRAEDMAVYYCARGLGYWGQGTLVTVSS

SEQ ID NO: 4450 - protein, 130 aa, Artificial Sequence
  Synthetic Polypeptide
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSS

SEQ ID NO: 4451 - protein, 117 aa, Artificial Sequence
  Synthetic Polypeptide
QVQLVQSGAEVKKPGSSVKVSCKASGGTFSSYTINVWRQAPGQGLEWMGGFIPISGTVNYAQKFQGRVTITADESTSTAYMELSSLRSEDTAVYYCARPLDWTEDIWGQGTLVTVSS

SEQ ID NO: 4452 - protein, 119 aa, Artificial Sequence
  Synthetic Polypeptide
EVQLVQSGAEVKKPGASVKVSCKASGYTFTAYYLHWLRQAPGQGLEWMGWMNTNNGATRYAQKFQDRVTMTRDTSINTAYMEMSGLSSDDTAMYYCARGDISQDFADVWGQGTLVTVSS

SEQ ID NO: 4453 - protein, 117 aa, Artificial Sequence
  Synthetic Polypeptide
QVQLQQSGAELMKPGASVKISCKATGYTFSSYWIEWVKQRPGHGLEWIGEILPGSGSTNYNEKFKGKATFTADTSSNTAYMQLSSLTSEDSAVYYCARYDYPWFAYWGQGTLVTVSA

SEQ ID NO: 4454 - protein, 118 aa, Artificial Sequence
  Synthetic Polypeptide
QVQLQQPGAELVRPGASVKLSCKASGYTFTSYWINWVKQRPGQGLEWIGNIYPSDSYTNYNQKFKDKATLTVDKSSSTAYMQLSSPTSEDSAVYYCTRSWRGNSFDYWGQGTTLTVSS

SEQ ID NO: 4455 - protein, 122 aa, Artificial Sequence
  Synthetic Polypeptide
QVQLVQSGAEVKKPGASVKVSCKASGYTFNGYFMNWVRQAPGQGLERMGRINPNNGDSFYNQKFQGRVTMTRDTSTSTVYMELPSLRSEDTAVYYCAREGYYGGRGYALDYWGQGTLVTVSS

SEQ ID NO: 4456 - protein, 121 aa, Artificial Sequence
  Synthetic Polypeptide
EVQLQQSGPDLVKPGASVKMSCKASGYTFTSYVMHWVKQKPGQGLEWIGYIYPYNDGTKYNEKFKGKATLTSDKSSSTAYMELSSLTSEDSAVYYCAREEYGNYVRYFDVWGAGTTVTVSS

SEQ ID NO: 4457 - protein, 117 aa, Artificial Sequence
  Synthetic Polypeptide
QVQLVQSGAEVKKPGSSVKVSCKASGDTFSSYYISWVRQAPGQGLEWMGRIIPILGIANYAQKYQGRVTLSADKSTSTSYMELNSLSSEDTAVYYCALDWSYSIDYWGQGTLVTVSS

SEQ ID NO: 4458 - protein, 120 aa, Artificial Sequence
  Synthetic Polypeptide
EVKLVESGGGLVKFGGSLKLSCAASGFTLSSYYMSWVRQSPEKRLELVAVINSNGGSTYYPDTVKGRFTISRDNAKNTLYLQMSSLKSEDTALYYCARPFYYSNSPFAYWGQGTLVTVSA

SEQ ID NO: 4459 - protein, 120 aa, Artificial Sequence
  Synthetic Polypeptide
EVQLEQSGPELVKPGASVKMSCKASGYTFTNYYMKWVKQSHGKSLEWIGDLNPNNGDTFYNQKFKGKATLTVDKSSNTAYMQLNSLTSEDSAVYYCARTGRYEENAMDYWGQGTSVTVSS

SEQ ID NO: 4460 - protein, 117 aa, Artificial Sequence; identical to SEQ ID NO: 4219
  Synthetic Polypeptide

SEQ ID NO: 4461 - protein, 117 aa, Artificial Sequence; identical to SEQ ID NO: 4215
  Synthetic Polypeptide

SEQ ID NO: 4462 - protein, 118 aa, Artificial Sequence
  Synthetic Polypeptide
QVQLQESGPGLVKPSQTLSLTCTVSGYSITSDYTWNWIRQPPGNGLEWIGYITYSGSTSYNPSLKSRVLISVDTSKNQVSLKLSSVTAADTAVYYCARLGRRYTMDYWGQGTTVTVSS

SEQ ID NO: 4463 - protein, 119 aa, Artificial Sequence
  Synthetic Polypeptide
EVILVESGGGLVKPGGSLKLSCAASGFTFSSYTMSWVRQTPEKRLEWVATISSGGGNTYYPDSVKGRFTISRDNAKNNLYLQMSSLRSEDTALYYCARYYRYEAWFASWGQGTLVTVSA

SEQ ID NO: 4464 - protein, 124 aa, Artificial Sequence
  Synthetic Polypeptide
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDKGGGYYDFWSGSDYWGQGTLVTVSS

SEQ ID NO: 4465 - protein, 127 aa, Artificial Sequence
  Synthetic Polypeptide
EVQLQQSGPGLVKPSQTLSLTCAISGDSVLSNSDTWNWIRQSPSRGLEWLGRTYHRSTWYDDYASSVRGRVSINVDTSKNQYSLQLNAVTPEDTGVYYCARDRLQDGNSWSDAFDVWGQGTMVTVSS

SEQ ID NO: 4466 - protein, 122 aa, Artificial Sequence
  Synthetic Polypeptide
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARGDSNYWSYYGMDVWGQGTLVTVSS

SEQ ID NO: 4467 - protein, 127 aa, Artificial Sequence
  Synthetic Polypeptide
EVQLQQSGPGLVKPSQTLSLTCAISGDSVSSNSAAWNWIRQSPSRGLEWLGRTYYRSKWYSDYAVSVKSRITINPDTSKNQFSLQLNSVTPEDTAVYYCARDPYDFWSGYPDAFDIWGQGTMVTVSS

SEQ ID NO: 4468 - protein, 111 aa, Artificial Sequence
  Synthetic Polypeptide
QSALTQPASASGSPGQSVTISCTGTSSDVGGYNYVSWYQQHPGKAPKLMIYDVSNRPSGVSNRFSGSKSGNTASLTISGLQAEDEADYYCSSYTSSSTLYVFGTGTQLTVL

SEQ ID NO: 4469 - protein, 120 aa, Artificial Sequence
  Synthetic Polypeptide
QVQLQESGPGLVKPSQTLSLTCTVSGVSLPDYGVSWIRQPPGKGLEWIGVIWGSETTYYNSALKSRVLISVDTSKNQVSLKLSSVTAADTAVYYCARHYYYGGSYAMDYWGQGTTVTVSS

SEQ ID NO: 4470 - protein, 120 aa, Artificial Sequence
  Synthetic Polypeptide
EVQLVESGGGLVQPGGSLRLSCAASGFSFNTYAMNWVRQAPGKGLEWVSHIRSKSNNFATYYADSVKDRFTISRDNAKNSLYLQMNSLRAEDTAVYYCARQGGDFPMDYWGQGTLVTVSS

SEQ ID NO: 4471 - protein, 118 aa, Artificial Sequence
  Synthetic Polypeptide
QVQLQESGPGLVKPSQTLSLTCTVSGYSITIDYTWNWIRQPPGKGLEWIGYITYSGSTDYNPSLKSRVLISVDTSKNQVSLKLSSVTAADTAVYYCARLGRRYALDYWGQGTTVTVSS

SEQ ID NO: 4472 - protein, 122 aa, Artificial Sequence
  Synthetic Polypeptide
EVQLVESGGGLVKPGGSLRLSCAASGFTFSNFEMNWVRQAPGKGLEWVSGISSNGRYINYADSVKGRFTISRDNAKNSLYLQMNSLRAEDTAVYYCARVVDFDQDYNGFDYWGQGTLVTVSS

SEQ ID NO: 4473 - protein, 120 aa, Artificial Sequence
  Synthetic Polypeptide
EVQLVESGGGLVKPGGSLRLSCAASGFTFSTYGMSWVRQAPGKGLEWVAYINNGSGYIYYADSVKGRFTISRDNAKNSLYLQMNSLRAEDTAVYYCARGQWWSGGDFDYWGQGTLVTVSS

SEQ ID NO: 4474 - protein, 124 aa, Artificial Sequence
  Synthetic Polypeptide
EVQLVESGGSLVQPGGSLRLSCAASGFTFDDYAMSWVRQVPGKGLEWVSSINWSGTHTDYADSVKGRFTISRNNANNTLYLQMNSLKSEDTAVYYCAKNWRDAGTTWFEKSGSAGQGTQVTVSS

SEQ ID NO: 4475 - protein, 118 aa, Artificial Sequence
  Synthetic Polypeptide
EVQLVESGGGLVQAGGSLRLSCAASGITFSINTMGWYRQAPGKQRELVALISSIGDTYYADSVKGRFTISRDNAKNTVYLQMNSLKPEDTAVYYCKRFRTAAQGTDYWGQGTQVTVSS

SEQ ID NO: 4476 - protein, 119 aa, Artificial Sequence
  Synthetic Polypeptide
EVQLVESGGGLVQPGGSLRLSCAASGSIFGFNDMAWYRQAPGKQRELVALISRVGVTSSADSVKGRFTISRVNAKDTVYLQMNSLKPEDTAVYYCYMDQRLDGSTLAYWGQGTQVTVSS

SEQ ID NO: 4477 - protein, 120 aa, Artificial Sequence
  Synthetic Polypeptide
DVQLVESGGGLVQPGGSLRLSCAASGSIGGLNAMAWYRQAPGKERELVAGIFGVGSTRYADSVKGRFTISRDNSKNTVYLQMNSLRPEDTAVYYCRMSSVTRGSSDYWGQGTLVTVSSLE

SEQ ID NO: 4478 - protein, 125 aa, Artificial Sequence
  Synthetic Polypeptide
EVQLVESGGGLVQPGGSLRLSCAASGRTYYLNAMGWFRQAPGKEREFVAAIDWSEGNKDYADSVKGRFTISRDNSKNTVYLQMNSLRPEDTAVYYCAADTPPWGPLIYIESYDSWGQGTLVTVSS

SEQ ID NO: 4479 - protein, 123 aa, Artificial Sequence
  Synthetic Polypeptide
EVQLVESGGGSVQAGGSLRLSCAASGDTYGSYWMGWFRQAPGKEREGVAAINRGGGYTVYADSVKGRFTISRDTAKNTVYLQMNSLRPDDTADYYCAASGVLGGLHEDWFNYWGQGTLVTVSS

SEQ ID NO: 4480 - protein, 122 aa, Artificial Sequence
  Synthetic Polypeptide
VQLVESGGGSVQAGGSLRLSCAASGDTYGSYWMGWFRQAPGQEREAVAAINRGGGYTVYADSVKGRFTISRDNAKNTLYLQMNSLRPDDTADYYCAASGVLGGLHEDWFNYWGQGTLVTVSS

SEQ ID NO: 4481 - protein, 124 aa, Artificial Sequence
  Synthetic Polypeptide
EVQLVESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTLVTVSS

SEQ ID NO: 4482 - protein, 124 aa, Artificial Sequence
  Synthetic Polypeptide
EVQLVESGGGSVQAGGSLRLTCAASGSTSRSYGMGWFRQAPGKEREFVSGISWRGDSTGYADSVKGRFTISRDNAKNTVDLQMNSLKPEDTAIYYCAAAAGSTWYGTLYEYDYWGQGTLVTVSS

SEQ ID NO: 4483 - protein, 125 aa, Artificial Sequence
  Synthetic Polypeptide
DVQLVESGGGLVQPGGSLRLSCAASGFILDYYAIGWFRQAPGKEREGVLCIDASDDITYYADSVKGRFTISRDNSKNTVYLQMNSLRPEDTAVYYCATPIGLSSSCLLEYDYDYWGQGTLVTVSS

SEQ ID NO: 4484 - protein, 126 aa, Artificial Sequence
  Synthetic Polypeptide
EVQLVESGGGLVQAGDSLRLSCAASGRAFSRYAMGWFRQAPGKEREFVAAIGWGPSKTNYADSVKGRFTISRDNAKNTVYLQMNTLKPEDTAVYSCAAKFVNTDSTWSRSEMYTYWGQGTLVTVSS

SEQ ID NO: 4485 - protein, 122 aa, Artificial Sequence
  Synthetic Polypeptide
EVQLVESGGGLVQAGGSLRLSCVASGISSSKRNMGWYRQAPGKQRESVATISSGGNKDYTDAVKDRFTISRDTTKNTVYLQMNSLKPEDTAVYYCKIEAGTGWATRRGYTYWGQGTLVTVSS

SEQ ID NO: 4486 - protein, 112 aa, Artificial Sequence
  Synthetic Polypeptide
QVQLVQSGGGLVQPGGSLRLSCAASDFDFAAYEMSWVRQAPGQGLEWVAIISHDGIDKYYTDSVKGRFTISRDNSKNTLYLQMNTLRAEDTATYYCLRLGAVGQGTLVTVSS

SEQ ID NO: 4487 - protein, 120 aa, Artificial Sequence
  Synthetic Polypeptide
QVQLVQSGGGLVQPGGSLRLSCAASDFAFDDYEMSWVRQAPGKALEWIGDINHSGTTIYNPSLKSRVTISRDNSKNTLYLQMNTLRAEDTAIYYCARPHYGDYSDAFDIWGQGTMVTVSS

SEQ ID NO: 4488 - protein, 115 aa, Artificial Sequence [sequence omitted]

SEQ ID NO: 4489 - protein, 116 aa, Artificial Sequence
  Synthetic Polypeptide
EVQLVESGGGLVQAGGSLRLSCAASGSIFSGNVMGWYRRQAPGKEREWVAAIASGGSIYYRDSVKGRFTISRDNAKNTVYLQMNSLKPEDTAVYYCNSHPPTLPYWGLGTQVTVSS

SEQ ID NO: 4490 - protein, 126 aa, Artificial Sequence
  Synthetic Polypeptide
EVQLVESGGGSVQAGGSLRLSCTTSGRALNMYVMGWFRQAPGNEREFVAATSSSGGSTSYPDSVKGRFTISRDNAKNTVYLQMNSLKPEDTAAYRCAASPYVSTPTMNILEEYRYWGLGTQVTVSS

SEQ ID NO: 4491 - protein, 121 aa, Artificial Sequence [sequence omitted]

SEQ ID NO: 4492 - protein, 266 aa, Artificial Sequence
  Synthetic Polypeptide
EVQLVESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTLVTVSSLEGGGGSGGGGSGGGGSFEEVQLVESGGGSVQAGGSLRLSCAASGDTYGSYWMGWFRQAPGKEREGVAAINRGGGYTVYADSVKGRFTISRDTAKNTVYLQMNSLRPDDTADYYCAASGVLGGLHEDWFNYWGQGTLVTVSS

SEQ ID NO: 4493 - protein, 285 aa, Artificial Sequence
  Synthetic Polypeptide
EVQLVESGGGSVQAGGSLRLTCAASGSTSRSYGMGWFRQAPGKEREFVSGISWRGDSTGYADSVKGRFTISRDNAKNTVDLQMNSLKPEDTAIYYCAAAAGSTWYGTLYEYDYWGQGTLVTVSSLEGGGGSGGGGSGGGGSGSGGSGSGGSGSGGSGSGGSFEVQLVESGGGSVQAGGSLRLSCAASGDTYGSYWMGWFRQAPGQEREAVAAINRGGGYTVYADSVKGRFTISRDNAKNTLYLQMNSLRPDDTADYYCAASGVLGGLHEDWFNYWGQGTLVTVSS

SEQ ID NO: 4494 - protein, 275 aa, Artificial Sequence
  Synthetic Polypeptide
EVQLVESGGGLVQAGGSLRLSCAASGITFSINTMGWYRQAPGKQRELVALISSIGDTYYADSVKGRFTISRDNAKNTVYLQMNSLKPEDTAVYYCKRFRTAAQGTDYWGQGTQVTVSSLEGGGGSGGGGSGGGGSGSGGSGSGGSGSGGSGSGGSFEVQLVESGGGLVQPGGSLRLSCAASGSIFGFNDMAWYRQAPGKQRELVALISRVGVTSSADSVKGRFTISRVNAKDTVYLQMNSLKPEDTAVYYCYMDQRLDGSTLAYWGQGTQVTVSS

SEQ ID NO: 4495 - protein, 242 aa, Artificial Sequence
  Synthetic Polypeptide
DIQMTQSPSSLSASVGDRVTITCRASQDVNTAVAWYQQKPGKAPKLLIYSASFLESGVPSRFSGSRSGTDFTLTISSLQPEDFATYYCQQHYTTPPTFGQTKVEIKRGGGGSGGGGSGGGGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDVWGQGTLVTVSS

SEQ ID NO: 4496 - protein, 280 aa, Artificial Sequence
  Synthetic Polypeptide
DVQLVESGGGLVQPGGSLRLSCAASGSIGGLNAMAWYRQAPGKERELVAGIFGVGSTRYADSVKGRFTISRDNSKNTVYLQMNSLRPEDTAVYYCRMSSVTRGSSDYWGQGTLVTVSSLEGGGGSGGGGSGGGGSGSGGSGSGGSGSGGSGSGGSFEVQLVESGGSLVQPGGSLRLSCAASGFTFDDYAMSWVRQVPGKGLEWVSSINWSGTHTDYADSVKGRFTISRNNANNTLYLQMNSLKSEDTAVYYCAKNWRDAGTTWFEKSGSAGQGTQVTVSS

SEQ ID NO: 4497 - protein, 288 aa, Artificial Sequence
  Synthetic Polypeptide
DVQLVESGGGLVQPGGSLRLSCAASGFILDYYAIGWFRQAPGKEREGVLCIDASDDITYYADSVKGRFTISRDNSKNTVYLQMNSLRPEDTAVYYCATPIGLSSSCLLEYDYDYWGQGTLVTVSSLEGGSGSGGGGSGGGGSGSGGSGSGGSGSGGSGSGGSFEVQLVESGGGLVQPGGSLRLSCAASGRTYYLNAMGWFRQAPGKEREFVAAIDWSEGNKDYADSVKGRFTISRDNSKNTVYLQMNSLRPEDTAVYYCAADTPPWGPLIYIESYDSWGQGTLVTVSS

SEQ ID NO: 4498 - protein, 271 aa, Artificial Sequence
  Synthetic Polypeptide
QVQLVQSGGGLVQPGGSLRLSCAASDFDFAAYEMSWVRQAPGQGLEWVAIISHDGIDKYYTDSVKGRFTISRDNSKNTLYLQMNTLRAEDTATYYCLRLGAVGQGTLVTVSSLEGGGGSGGGGSGGGGSGSGGSGSGGSGSGGSGSGGSFEQVQLVQSGGGLVQPGGSLRLSCAASDFAFDDYEMSWVRQAPGKALEWIGDINHSGTTIYNPSLKSRVTISRDNSKNTLYLQMNTLRAEDTAIYYCARPHYGDYSDAFDIWGQGTMVTVSS

SEQ ID NO: 4499 - protein, 119 aa, Artificial Sequence
  Synthetic Polypeptide
QVKLEESGGGLVQAGRSLRLSCAASEHTFSSHVMGWFRQAPGKERESVAVIGWRDISTSYADSVKGRFTISRDNAKKTLYLQMNSLKPEDTAVYYCAARRIDAADFDSWGQGTQVTVSS

SEQ ID NO: 4500 - protein, 118 aa, Artificial Sequence
  Synthetic Polypeptide
EVQLVESGGGLVQAGGSLRLSCAASGRTFTMGWFRQAPGKEREFVAAISLSPTLAYYAESVKGRFTISRDNAKNTVVLQMNSLKPEDTALYYCAADRKSVMSIRPDYWGQGTQVTVSS

SEQ ID NO: 4501 - protein, 252 aa, Artificial Sequence
  Synthetic Polypeptide
QVKLEESGGGLVQAGRSLRLSCAASEHTFSSHVMGWFRQAPGKERESVAVIGWRDISTSYADSVKGRFTISRDNAKKTLYLQMNSLKPEDTAVYYCAARRIDAADFDSWGQGTQVTVSSGGGGSGGGGSGGGGSEVQLVESGGGLVQAGGSLRLSCAASGRTFTMGWFRQAPGKEREFVAAISLSPTLAYYAESVKGRFTISRDNAKNTVVLQMNSLKPEDTALYYCAADRKSVMSIRPDYWGQGTQVTVSS

SEQ ID NO: 4502 - protein, 116 aa, Artificial Sequence
  Synthetic Polypeptide
EVQLVESGGGLVQAGGSLRLSCIATGKVFSIYDMGWYRQAPGKQRELVAEITSSGTTHYDDFVSGRFTISRDNAKNTVYLQMNTLKAEDTAVYYCRANHVFGGSYWGQGTQVTVSS

SEQ ID NO: 4503 - protein, 122 aa, Artificial Sequence
  Synthetic Polypeptide
QVQLVESGGGLVQPGGSLRLSCEASGFTLDYYAIGWFRQAPGKEREGVICISRSDGSTYYADSVKGRFTISRDNAKKTVYLQMISLKPEDTAAYYCAAGADCSGYLRDYEFRGQGTQVTVSS

SEQ ID NO: 4504 - protein, 245 aa, Artificial Sequence
  Synthetic Polypeptide
EVQLVESGGGLVQAGGSLRLSCIATGKVFSIYDMGWYRQAPGKQRELVAEITSSGTTHYDDFVSGRFTISRDNAKNTVYLQMNTLKAEDTAVYYCRANHVFGGSYWGQGTQVTVSSEVAALEKQVQLVESGGGLVQPGGSLRLSCEASGFTLDYYAIGWFRQAPGKEREGVICISRSDGSTYYADSVKGRFTISRDNAKKTVYLQMISLKPEDTAAYYCAAGADCSGYLRDYEFRGQGTQVTVSS

SEQ ID NO: 4505 - protein, 128 aa, Artificial Sequence
  Synthetic Polypeptide
QVKLEESGGRLVQPRGSLRLSCAGSGRTFSTYGMAWFRQAPGKEREFVASKASMNYSGRTYYADSVKGRFTIARDNAKNMVFLQMNNLKPEDTAVYYCAAGTGCSTYGCFDAQIIDYWGKGTLVTVSS

SEQ ID NO: 4506 - protein, 119 aa, Artificial Sequence
  Synthetic Polypeptide
QVKLEESGGGLVQPGESLRLSCSASGSIFKVFRVFAMSWYRQGPGKQRELVASISSGETTTYADSVKGRFTISRDNAKNTAYLQMDSLKPEDTAVYYCNADHTFTGDFWGQGTQVTVSS

SEQ ID NO: 4507 - protein, 254 aa, Artificial Sequence
  Synthetic Polypeptide
QVKLEESGGRLVQPRGSLRLSCAGSGRTFSTYGMAWFRQAPGKEREFVASKASMNYSGRTYYADSVKGRFTIARDNAKNMVFLQMNNLKPEDTAVYYCAAGTGCSTYGCFDAQIIDYWGKGTLVTVSSEVAALEKQVKLEESGGGLVQPGESLRLSCSASGSIFKVFRVFAMSWYRQGPGKQRELVASISSGETTTYADSVKGRFTISRDNAKNTAYLQMDSLKPEDTAVYYCNADHTFTGDFWGQGTQVTVSS

SEQ ID NO: 4508 - protein, 117 aa, Artificial Sequence
  Synthetic Polypeptide
QVKLEESGGELVQPGGPLRLSCAASGNIFSINRMGWYRQAPGKQRAFVASITVRGITNYADSVKGRFTISVDKSKNTIYLQMNALKPEDTAVYYCNAVSSNRDPDYWGQGTQVTVSS

SEQ ID NO: 4509 - protein, 129 aa, Artificial Sequence
  Synthetic Polypeptide
PVQLVESGGGLVQAGDSLRLSCAASGRTFGIGTMGWFRQPPGKEREFVAAIRWSTGGTRYADSVKGRFTISRDNAKLTVDLQMDSLKPEDTAVYYCAADRLSLDLSGRYHYNPAVYDYWGQGTQVTVSS

SEQ ID NO: 4510 - protein, 261 aa, Artificial Sequence
  Synthetic Polypeptide
QVKLEESGGELVQPGGPLRLSCAASGNIFSINRMGWYRQAPGKQRAFVASITVRGITNYADSVKGRFTISVDKSKNTIYLQMNALKPEDTAVYYCNAVSSNRDPDYWGQGTQVTVSSGGGGSGGGGSGGGGSPVQLVESGGGLVQAGDSLRLSCAASGRTFGIGTMGWFRQPPGKEREFVAAIRWSTGGTRYADSVKGRFTISRDNAKLTVDLQMDSLKPEDTAVYYCAADRLSLDLSGRYHYNPAVYDYWGQGTQVTVSS

SEQ ID NO: 4511 - protein, 119 aa, Artificial Sequence
  Synthetic Polypeptide
AVQLVESGGGLVQAGDSLRLTCTASGRAFSTYFMAWFRQAPGKEREFVAGIAWSGGSTAYADSVKGRFTISRDNAKNTVYLQMNSLKSEDTAVYYCASRGIEVEEFGAWGQGTQVTVSS

SEQ ID NO: 4512 - protein, 120 aa, Artificial Sequence
  Synthetic Polypeptide
QVQLVESGGGLVQAGGSLRLSCAASGGTLSKNTVAWFRQAPGKERGFVASITWDGRTTYYADSVKGRFTISRDNAKNTVYLQMNSLKPEDTAVYVCADLGKWPAGPADYWGQGTQVTVSS

SEQ ID NO: 4513 - protein, 246 aa, Artificial Sequence
  Synthetic Polypeptide
AVQLVESGGGLVQAGDSLRLTCTASGRAFSTYFMAWFRQAPGKEREFVAGIAWSGGSTAYADSVKGRFTISRDNAKNTVYLQMNSLKSEDTAVYYCASRGIEVEEFGAWGQGTQVTVSSPGGGGSPQVQLVESGGGLVQAGGSLRLSCAASGGTLSKNTVAWFRQAPGKERGFVASITWDGRTTYYADSVKGRFTISRDNAKNTVYLQMNSLKPEDTAVYVCADLGKWPAGPADYWGQGTQVTVSS

SEQ ID NO: 4514 - protein, 274 aa, Artificial Sequence
  Synthetic Polypeptide
AVQLVESGGGLVQAGDSLRLTCTASGRAFSTYFMAWFRQAPGKEREFVAGIAWSGGSTAYADSVKGRFTISRDNAKNTVYLQMNSLKSEDTAVYYCASRGIEVEEFGAWGQGTQVTVSSPGGGGSPQVQLVESGGGLVQAGGSLRLSCAASGGTLSKNTVAWFRQAPGKERGFVASITWDGRTTYYADSVKGRFTISRDNAKNTVYLQMNSLKPEDTAVYVCADLGKWPAGPADYWGQGTQVTVSSEVAALEKEVAALEKEVAALEKEVAALEK

SEQ ID NO: 4515 - protein, 124 aa, Artificial Sequence
  Synthetic Polypeptide
GSDLGIKLLFAAAKGQDDEVRILLAAGADVNAKDFEGYTPLHVAAYDGHLEIVEVLLKAGADVNAKDSQGRTPLHEAAYSGHLEIVEVLLKAGADVNAQDDAGETPADLAAAWGHEDIAEVLQK

SEQ ID NO: 4516 - protein, 126 aa, Artificial Sequence
  Synthetic Polypeptide
RSDLGKKLLEAARAGQDDEVRILMANGADVNAKDEYGLTPLYLATAHGHLEIVEVLLKNGADVNAVDAIGFTPLHLAAFIGHLEIAEVLLKHGADVNAQDKFGKTAFDISIGNGNEDLAEILQKLN

SEQ ID NO: 4517 - protein, 58 aa, Artificial Sequence
  Synthetic Polypeptide
VDNKFNKERYSAYYEIWQLPNLNVRQKAAFIGSLQDDPSQSANLLAEAKKLNDAQAPK

SEQ ID NO: 4518 - protein, 51 aa, Artificial Sequence
  Synthetic Polypeptide
YAKEMRNAYWEIALLPNLTNQQKRAPIRKLYDDPSQSSELLSEAKKLNDSQ

SEQ ID NO: 4519 - protein, 51 aa, Artificial Sequence
  Synthetic Polypeptide
YAKEMWIAWEEIRNLPNLNGWQMTAFIAKLLDDPSQSSELLSEAKKLNDSQ

SEQ ID NO: 4520 - protein, 269 aa, Artificial Sequence
  Synthetic Polypeptide
EPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGGW

SEQ ID NO: 4521 - protein, 490 aa, Artificial Sequence
  Synthetic Polypeptide
MPSWALFMVTSCLLLAPQNLAQVSSQDVSLLASDSEPLKCFSRTFEDLTCFWDEEEAAPSGTYQLLYAYPREKPRACPLSSQSMPHFGTRYVCQFPDQEEVRLFFPLHLWVKNVFLNQTRTQRVLFVDSVGLPAPPSIIKAMGGSQPGELQISWEEPAPEISDFLRYELRYGPRDPKNSTGPTVIQLIATETCCPALQRPHSASALDQSPCAQPTMPWQDGPKQTSPSREASALTAEGGSCLISGLQPGNSYWLQLRSEPDGISLGGSWGSWSLPVTVDLPGDAVALGLQCFTLDLKNVTCQWQQQDHASSQGFFYHSRARCCPRDRYPIWENCEEEEKTNPGLQTPQFSRCHFKSRNDSIIHILVEVTTAPGTVHSYLGSPFWIHQAVRLPTPNLHWREISSGHLELEWQHPSSWAAQETCYQLRYTGEGHQDWKVLEPPLGARGGTLELRPRSRYRLQLRARLNGPTYQGPWSSWSDPTRVETATETA

SEQ ID NO: 4522 - protein, 167 aa, Artificial Sequence
  Synthetic Polypeptide
MALPVTALLLPLALLLHAARPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQ

SEQ ID NO: 4523 - protein, 146 aa, Artificial Sequence
  Synthetic Polypeptide
GWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQ

SEQ ID NO: 4524 - protein, 167 aa, Artificial Sequence
  Synthetic Polypeptide
MQIPQAPWPVVWAVLQLGWRPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQ

SEQ ID NO: 4525 - protein, 162 aa, Artificial Sequence
  Synthetic Polypeptide
MACLGFQRHKAQLNLATRTWPCTLLFFLLFIPVFCKAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDF

SEQ ID NO: 4526 - protein, 241 aa, Artificial Sequence
  Synthetic Polypeptide
MRRAALWLWLCALALSLQPALPQIVATNLPPEDQDGSGDDSDNFSGSGAGALQDITLSQQTPSTWKDTQLLTAIPTSPEPTGLEATAASTSTLPAGEGPKEGEAVVLPEVEPGLTAREQEATPRPRETTQLPTTHQASTTTATTAQEPATSHPHRDMQPGHHETSTPAGPSQADLHTPHTEDGGPSATERAAEDGASSQLPAAEGSGEQDFTFETSGENTAVVAVEPDRRNQSPVDQGATG

SEQ ID NO: 4527 - protein, 300 aa, Artificial Sequence
  Synthetic Polypeptide
MVLLWLTLLLIALPCLLQTKEDPNPPITNLRMKAKAQQLTWDLNRNVTDIECVKDADYSMPAVNNSYCQFGAISLCEVTNYTVRVANPPFSTWILFPENSGKPWAGAENLTCWIHDVDFLSCSWAVGPGAPADVQYDLYLNVANRRQQYECLHYKTDAQGTRIGCRFDDISRLSSGSQSSHILVRGRSAAFGIPCTDKFVVFSQIEILTPPNMTAKCNKTHSFMHWKMRSHFNRKFRYELQIQKRMQPVITEQVRDRTSFQLLNPGTYTVQIRARERVYEFLSAWSTPQRFECDQEEGAN

SEQ ID NO: 4528 - protein, 709 aa, Artificial Sequence
  Synthetic Polypeptide
MGPWSRSLSALLLLLQVSSWLCQEPEPCHPGFDAESYTFTVPRRHLERGRVLGRVNFEDCTGRQRTAYFSLDTRFKVGTDGVITVKRPLRFHNPQIHFLVYAWDSTYRKFSTKVTLNTVGHHHRPPPHQASVSGIQAELLTFPNSSPGLRRQKRDWVIPPISCPENEKGPFPKNLVQIKSNKDKEGKVFYSITGQGADTPPVGVFIIERETGWLKVTEPLDRERIATYTLFSHAVSSNGNAVEDPMEILITVTDQNDNKPEFTQEVFKGSVMEGALPGTSVMEVTATDADDDVNTYNAAIAYTILSQDPELPDKNMFTINRNTGVISVVTTGLDRESFPTYTLVVQAADLQGEGLSTTATAVITVTDTNDNPPIFNPTTYKGQVPENEANVVITTLKVTDADAPNTPAWEAVYTILNDDGGQFVVTTNPVNNDGILKTAKGLDFEAKQQYILHVAVTNVVPFEVSLTTSTATVTVDVLDVNEAPIFVPPEKRVEVSEDFGVGQEITSYTAQEPDTFMEQKITYRIWRDTANWLEINPDTGAISTRAELDREDFEHVKNSTYTALIIATDNGSPVATGTGTLLLILSDVNDNAPIPEPRTIFFCERNPKPQVINIIDADLPPNTSPFTAELTHGASANWTIQYNDPTQESIILKPKMALEVGDYKINLKLMDNQNKDQVTTLEVSVCDCEGAAGVCRKAQPVEAGLQIPA

SEQ ID NO: 4529 - protein, 239 aa, Artificial Sequence
  Synthetic Polypeptide
MSAPRLLISIIIMVSASSSSCMGGKQMTQNYSTIFAEGNISQPVLMDINAVLCCPPIALRNLIIITWEIILRGQPSCTKAYKKETNETKETNCTVERITWVSRPDQNSDLQILPVDTTHDGYYRGIVVTPDGNFHRGYHLQVLVTPEVNLFQSRNITAVCKAVTGKPAAQISWIPEGSILATKQEYWGNGTVTVKSTCPWEGHKSTVTCHVSHLTGNKSLSVKLNSGLRTSGSPALSLL

SEQ ID NO: 4530 - protein, 488 aa, Artificial Sequence
  Synthetic Polypeptide
MECLYYFLGFLLLAARLPLDAAKRFHDVLGNERPSAYMREHNQLNGWSSDENDWNEKLYPVWKRGDMRWKNSWKGGRVQAVLTSDSPALVGSNITFAVNLIFPRCQKEDANGNIVYEKNCRNEAGLSADPYVYNWTAWSEDSDGENGTGQSHHNVFPDGKPFPHHPGWRRWNFIYVFHTLGQYFQKLGRCSVRVSVNTANVTLGPQLMEVTVYRRHGRAYVPIAQVKDVYVVTDQIPVFVTMFQKNDRNSSDETFLKDLPIMFDVLIHDPSHFLNYSTINYKWSFGDNTGLFVSTNHTVNHTYVLNGTFSLNLTVKAAAPGPCPPPPPPPRPSKPTPSLGPAGDNPLELSRIPDENCQINRYGHFQATITIVEGILEVNIIQMTDVLMPVPWPESSLIDFVVTCQGSIPTEVCTIISDPTCEITQNTVCSPVDVDEMCLLTVRRTFNGSGTYCVNLTLGDDTSLALTSTLISVPDRDPASPLRMANSA

SEQ ID NO: 4531 - protein, 664 aa, Artificial Sequence
  Synthetic Polypeptide
MGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRLPTHGRVYQKGHELVLANIAESDAGVYTCHAANLAGQRRQDVNITVATVPSWLKKPQDSQLEEGKPGYLDCLTQATPKPTVVWYRNQMLISEDSRFEVFKNGTLRINSVEVYDGTWYRCMSSTPAGSIEAQARVQVLDGSSLPEWVTDNAGTLHFARVTRDDAGNYTCIASNGPQGQIRAHVQLTVAVFITFKVEPERTTVYQGHTALLQCEAQGDPKPLIQWKGKDRILDPTKLGPRMHIFQNGSLVIHDVAPEDSGRYTCIAGNSCNIKHTEAPLYVVDKPVPEESEGPGSPPPYKMIQT

SEQ ID NO: 4532 - protein, 252 aa, Artificial Sequence
  Synthetic Polypeptide
MPLLLLLPLLWAGALAMDPNFWLQVQESVTVQEGLCVLVPCTFFHPIPYYDKNSPVHGYWFREGAIISGDSPVATNKLDQEVQEETQGRFRLLGDPSRNNCSLSIVDARRRDNGSYFFRMERGSTKYSYKSPQLSVHVTDLTHRPKILIPGTLEPGHSKNLTCSVSWACEQGTPPIFSWLSAAPTSLGPRTTHSSVLIITPRPQDHGTNLTCQVKFAGAGVTTERTIQLNVTYVPQNPTTGIFPGDGSGKQE

SEQ ID NO: 4533 - protein, 290 aa, Artificial Sequence
  Synthetic Polypeptide
MLVRRGARAGPRMPRGWTALCLLSLLPSGFMSLDNNGTATPELPTQGTFSNVSTNVSYQETTTPSTLGSTSLHPVSQHGNEATTNITETTVKFTSTSVITSVYGNTNSSVQSQTSVISTVFTTPANVSTPETTLKPSLSPGNVSDLSTTSTSLATSPTKPYTSSSPILSDIKAEIKCSGIREVKLTQGICLEQNKTSSCAEFKKDRGEGLARVLCGEEQADADAGAQVCSLLLAQSEVRPQCLLLVLANRTEISSKLQLMKKHQSDLKKLGILDFTEQDVASHQSYSQKT

SEQ ID NO: 4534 - protein, 268 aa, Artificial Sequence
  Synthetic Polypeptide
MAPPQVLAFGLLLAAATATFAAAQEECVCENYKLAVNCFVNNNRQCQCTSVGAQNTVICSKLAAKCLVMKAEMNGSKLGRRAKPEGALQNNDGLYDPDCDESGLFKAKQCNGTSTCWCVNTAGVRRTDKDTEITCSERVRTYWIIIELKHKAREKPYDSKSLRTALQKEITTRYQLDPKFITSILYENNVITIDLVQNSSQKTQNDVDIADVAYYFEKDVKGESLFHSKKMDLTVNGEQLDLDPGQTLIYYVDEKAPEFSMQGLKQAR

SEQ ID NO: 4535 - protein, 265 aa, Artificial Sequence
  Synthetic Polypeptide
MSEEVTYADLQFQNSSEMEKIPEIGKFGEKAPPAPSHVWRPAALFLTLLCLLLLIGLGVLASMFHVTLKIEMKKMNKLQNISEELQRNISLQLMSNMNISNKIRNLSTTLQTIATKLCRELYSKEQEHKCKPCPRRWIWHKDSCYFLSDDVQTWQESKMACAAQNASLLKINNKNALEFIKSQSRSYDYWLGLSPEEDSTRGMRVDNIINSSAWVIRNAPDLNNMYCGYINRLYVQYYHCTYKQRMICEKMANPVQLGSTYFREA

SEQ ID NO: 4536 - protein, 163 aa, Artificial Sequence
  Synthetic Polypeptide
MALPVTALLLPLALLLHAARPFECPAGIYAPICSGGGGSCGGGGSKISHFLKMESLNFIRAHTPYINIYNCEPANPSEKNSPSTQYCYSIQSGGGGSCGGGGSPAGIYAPIGGGGSKISHFLKMESLNFIRAHTPYINIYNCEPANPSEKNSPSTQYCYSIQS

SEQ ID NO: 4537 - protein, 105 aa, Artificial Sequence
  Synthetic Polypeptide
MALPVTALLLPLALLLHAARPFECPAGIYAPICSGGGGSCGGGGSKISHFLKMESLNFIRAHTPYINIYNCEPANPSEKNSPSTQYCYSIQSGGGGSCGGGGSTR

SEQ ID NO: 4538 - protein, 515 aa, Artificial Sequence
  Synthetic Polypeptide
MSLWLLEGVPMRQAAVTSTSLTIKSVFTRSELKFSPQWSHHGKIVTCQLQDADGKFLSNDTVQLNVKHTPKLEIKVTPSDAIVREGDSVTMTCEVSSSNPEYTTVSWLKDGTSLKKQNTFTLNLREVTKDQSGKYCCQVSNDVGPGRSEEVFLQVQYAPEPSTVQILHSPAVEGSQVEFLCMSLANPLPTNYTWYHNGKEMQGRTEEKVHIPKILPWHAGTYSCVAENILGTGQRGPGAELDVQYPPKKVTTVIQNPMPIREGDTVTLSCNYNSSNPSVTRYEWKPHGAWEEPSLGVLKIQNVGWDNTTIACAACNSWCSWASPVALNVQYAPRDVRVRKIKPLSEIHSGNSVSLQCDFSSSHPKEVQFFWEKNGRLLGKESQLNFDSISPEDAGSYSCWVNNSIGQTASKAWTLEVLYAPRRLRVSMSPGDQVMEGKSATLTCESDANPPVSHYTWFDWNNQSLPYHSQKLRLEPVKVQHSGAYWCQGTNSVGKGRSPLSTLTVYYSPETIGRR

SEQ ID NO: 4539 - protein, 413 aa, Artificial Sequence
  Synthetic Polypeptide
MRPADLLQLVLLLDLPRDLGGMGCSSPPCECHQEEDFRVTCKDIQRIPSLPPSTQTLKLIETHLRTIPSHAFSNLPNISRIYVSIDVTLQQLESHSFYNLSKVTHIEIRNTRNLTYIDPDALKELPLLKFLGIFNTGLKMFPDLTKVYSTDIFFILEITDNPYMTSIPVNAFQGLCNETLTLKLYNNGFTSVQGYAFNGTKLDAVYLNKNKYLTVIDKDAFGGVYSGPSLLDVSQTSVTALPSKGLEHLKELIARNTWTLKKLPLSLSFLHLTRADLSYPSHCCAFKNQKKIRGILESLMCNESSMQSLRQRKSVNALNSPLHQEYEENLGDSIVGYKEKSKFQDTHNNAHYYVFFEEQEDEIIGFGQELKNPQEETLQAFDSHYDYTICGDSEDMVCTPKSDEFNPCEDIMG

SEQ ID NO: 4540 - protein, 361 aa, Artificial Sequence
  Synthetic Polypeptide
MRPSGTAGAALLALLAALCPASRALEEKKGNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGC

SEQ ID NO: 4541 - protein, 54 aa, Artificial Sequence
  Synthetic Polypeptide
MLQMAGQCSQNEYFDSLLHACIPCQLRCSSNTPPLTCQRYCNASVTNSVKGTNA

SEQ ID NO: 4542 - protein, 226 aa, Artificial Sequence
  Synthetic Polypeptide
MAGSPTCLTLIYILWQLTGSAASGPVKELVGSVGGAVTFPLKSKVKQVDSIVWTFNTTPLVTIQPEGGTIIVTQNRNRERVDFPDGGYSLKLSKLKKNDSGIYYVGIYSSSLQQPSTQEYVLHVYEHLSKPKVTMGLQSNKNGTCVTNLTCCMEHGEEDVIYTWKALGQAANESHNGSILPISWRWGESDMTFICVARNPVSRNFSSPILARKLCEGAADDPDSSM

SEQ ID NO: 4543 - protein, 135 aa, Artificial Sequence
  Synthetic Polypeptide
LFNQEVQIPLTESYCGPCPKNWICYKNNCYQFFDESKNWYESQASCMSQNASLLKVYSKEDQDLLKLVKSYHWMGLVHIPTNGSWQWEDGSILSPNLLTIIEMQKGDCALYASSFKGYIENCSTPNTYICMQRTV

SEQ ID NO: 4544 - protein, 187 aa, Artificial Sequence
  Synthetic Polypeptide
MELTELLLVVMLLLTARLTLSSPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLLGTQLPPQGRTTAHKDPNAIFLSFQHLLRGKVRFLMLVGGSTLCVRRAPPTTAVPSRTS

SEQ ID NO: 4545 - protein, 187 aa, Artificial Sequence
  Synthetic Polypeptide
MELTDLLLAAMLLAVARLTLSSPVAPACDPRLLNKLLRDSHLLHSRLSQCPDVDPLSIPVLLPAVDFSLGEWKTQTEQSKAQDILGAVSLLLEGVMAARGQLEPSCLSSLLGQLSGQVRLLLGALQGLLGTQLPLQGRTTAHKDPNALFLSLQQLLRGKVRFLLLVEGPTLCVRRTLPTTAVPSSTS

SEQ ID NO: 4546 - protein, 92 aa, Artificial Sequence
  Synthetic Polypeptide
APDVQDCPECTLQENPFFSQPGAPILQCMGCCFSRAYPTPLRSKKTMLVQKNVTSESTCCVAKSYNRVTVMGGFKVENHTACHCSTCYYHKS

SEQ ID NO: 4547 - protein, 165 aa, Artificial Sequence
  Synthetic Polypeptide
MEMFQGLLLLLLLSMGGTWASREMLRPRCRPINATLAVEKEGCPVCITVNTTICAGYCPTMTRVLQGVLPALPQVVCNYRDVRFESIRLPGCPRGVNPVVSYAVALSCQCALCRRSTTDCGGPKDHPLTCDDPRFQASSSSKAPPPSLPSPSRLPGPSDTPILPQ

SEQ ID NO: 4548 - protein, 111 aa, Artificial Sequence
  Synthetic Polypeptide
NSCELTNITIAIEKEECRFCISINTTWCAGYCYTRDLVYKDPARPKIQKTCTFKELVYETVRVPGCAHHADSLYTYPVATQCHCGKCDSDSTDCTVRGLGPSYCSFGEMKE

SEQ ID NO: 4549 - protein, 141 aa, Artificial Sequence
  Synthetic Polypeptide
MEMLQGLLLLLLLSMGGAWASREPLRPWCHPINAILAVEKEGCPVCITVNTTICAGYCPTMMRVLQAVLPPLPQVVCTYRDVRFESIRLPGCPRGVDPVVSFPVALSCRCGPCRRSTSDCGGPKDHPLTCDHPQLSGLLFL

SEQ ID NO: 4550 - protein, 138 aa, Artificial Sequence
  Synthetic Polypeptide
MTALFLMSMLFGLACGQAMSFCIPTEYTMHIERRECAYCLTINTTICAGYCMTRDINGKLFLPKYALSQDVCTYRDFIYRTVEIPGCPLHVAPYFSYPVALSCKCGKCNTDYSDCIHEAIKTNYCTKPQKSYLVGFSV

SEQ ID NO: 4551 - protein, 272 aa, Artificial Sequence
  Synthetic Polypeptide
MEMFQGLLLLLLLSMGGTWASREMLRPRCRPINATLAVEKEGCPVCITVNTTICAGYCPTMTRVLQGVLPALPQVVCNYRDVRFESIRLPGCPRGVNPVVSYAVALSCQCALCRRSTTDCGGPKDHPLTCDDPRFQASSSSKAPPPSLPSPSRLPGPSDTPILPQGGGGSGGGGSGGGGSAPDVQDCPECTLQENPFFSQPGAPILQCMGCCFSRAYPTPLRSKKTMLVQKNVTSESTCCVAKSYNRVTVMGGFKVENHTACHCSTCYYHKS

SEQ ID NO: 4552 - protein, 239 aa, Artificial Sequence
  Synthetic Polypeptide
MALPVTALLLPLALLLHAARPNSCELTNITIAIEKEECRFCISINTTWCAGYCYTRDLVYKDPARPKIQKTCTFKELVYETVRVPGCAHHADSLYTYPVATQCHCGKCDSDSTDCTVRGLGPSYCSFGEMKEGGGGSGGGGSGGGGSAPDVQDCPECTLQENPFFSQPGAPILQCMGCCFSRAYPTPLRSKKTMLVQKNVTSESTCCVAKSYNRVTVMGGFKVENHTACHCSTCYYHKS

SEQ ID NO: 4553 - protein, 248 aa, Artificial Sequence
  Synthetic Polypeptide
MEMLQGLLLLLLLSMGGAWASREPLRPWCHPINAILAVEKEGCPVCITVNTTICAGYCPTMMRVLQAVLPPLPQVVCTYRDVRFESIRLPGCPRGVDPVVSFPVALSCRCGPCRRSTSDCGGPKDHPLTCDHPQLSGLLFLGGGGSGGGGSGGGGSAPDVQDCPECTLQENPFFSQPGAPILQCMGCCFSRAYPTPLRSKKTMLVQKNVTSESTCCVAKSYNRVTVMGGFKVENHTACHCSTCYYHKS

SEQ ID NO: 4554 - protein, 245 aa, Artificial Sequence
  Synthetic Polypeptide
MTALFLMSMLFGLACGQAMSFCIPTEYTMHIERRECAYCLTINTTICAGYCMTRDINGKLFLPKYALSQDVCTYRDFIYRTVEIPGCPLHVAPYFSYPVALSCKCGKCNTDYSDCIHEAIKTNYCTKPQKSYLVGFSVGGGGSGGGGSGGGGSAPDVQDCPECTLQENPFFSQPGAPILQCMGCCFSRAYPTPLRSKKTMLVQKNVTSESTCCVAKSYNRVTVMGGFKVENHTACHCSTCYYHKS

SEQ ID NO: 4555 - protein, 242 aa, Artificial Sequence
  Synthetic Polypeptide
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSS

SEQ ID NO: 4556 - protein, 242 aa, Artificial Sequence
  Synthetic Polypeptide
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSS

SEQ ID NO: 4557 - protein, 243 aa, Artificial Sequence
  Synthetic Polypeptide
DEIVLTQSPATLSLSPGERATLSCSASSSVSYMHWYQQKPGQAPRLLIYDTSKLASGIPARFSGSGSGTDFTLTISSLEPEDVAVYYCFQGSVYPFTFGQGTKLEIKRGGGGSGGGGSGGGGSQVQLQESGPGLVKPSQTLSLTCTVSGGSISTSGMGVGWIRQHPGKGLEWIGHIWWDDDKRYNPALKSRVTISVDTSKNQFSLKLSSVTAADTAVYYCARMELWSYYFDYWGQGTLVTVSS

SEQ ID NO: 4558 - protein, 250 aa, Artificial Sequence
  Synthetic Polypeptide
DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSS

SEQ ID NO: 4559 - protein, 249 aa, Artificial Sequence
  Synthetic Polypeptide
DIVMTQAAPSIPVTPGESVSISCRSSKSLLNSNGNTYLYWFLQRPGQSPQLLIYRMSNLASGVPDRFSGSGSGTAFTLRISRVEAEDVGVYYCMQHLEYPFTFGAGTKLELKRGGGGSGGGGSGGGGSEVQLQQSGPELIKPGASVKMSCKASGYTFTSYVMHWVKQKPGQGLEWIGYINPYNDGTKYNEKFKGKATLTSDKSSSTAYMELSSLTSEDSAVYYCARGTYYYGSRVFDYWGQGTTLTVSS

SEQ ID NO: 4560 - protein, 249 aa, Artificial Sequence; identical to SEQ ID NO: 4559
  Synthetic Polypeptide

SEQ ID NO: 4561 - protein, 249 aa, Artificial Sequence; identical to SEQ ID NO: 4559
  Synthetic Polypeptide

SEQ ID NO: 4562 - protein, 267 aa, Artificial Sequence
  Synthetic Polypeptide
INIYNAEPANPSEKNSPEFDIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIKGGGGSGGGGSGGGGSEVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSS

SEQ ID NO: 4563 - protein, 249 aa, Artificial Sequence
  Synthetic Polypeptide
DILLTQSPATLSLSPGERATLSCRASQSVDYDGDSYLNWYQQKPGQPPKLLIYDASNLVSGIPPRFSGSGSGTDFTLTISRLEPEDFAVYHCQQSTEDPWTFGGGTKLEIKGGGGSGGGGSGGGGSQVQLVESGGGLVEPGGSLRLSCMSGYAFSSYWMNWVRQMPGKGLEWMGQIWPGDGDTNYNPSLKSRVTITADESTSTAYMELSSLKAEDTAVYFCARRETTTVGRYYYAMDYWGQGTLVTVSS

SEQ ID NO: 4564 - protein, 246 aa, Artificial Sequence
  Synthetic Polypeptide
DILLTQSPATLSLSPGERATLSCRASQSVDNYGISFMNWYQQKPGQPPKLLIYAASNQGSGIPSRFSGSGSGTDFTLTISSLEPEDFAMYFCQQSNEVPRTFGGGTKLEIKGGGGSGGGGSGGGGSQVQLVESGGGLVEPGGSLRLSCMSGYAFSSSWMNWVRQMPGKGLEWMGRIYPGDGDTNYNGKFKERVTITADESTSTAYMELSSLKAEDTAVYFCARSEYWGNYWAMDYWGQGTLVTVSS

SEQ ID NO: 4565 - protein, 245 aa, Artificial Sequence
  Synthetic Polypeptide
DILLTQSPATLSLSPGERATLSCKASQNVGTNVAWYQQKPGQPPKLLIYSATYRNSGIPARFSGSGSGTEFTLTITNVQSKDLADYFYFCQYNRYPYTSGGGTKLEIKRGGGGSGGGGSGGGGSQVQLVESGGGLVEPGGSLRLSCMSGYAFSSYWMNWVRQMPGKGLEWMGQIYPGDGDTNYNGKFKGRVTITADESTSTAYMELSSLKAEDTAVYFCARKTISSVVDFYFDNWGQGTLVTVSS

SEQ ID NO: 4566 - protein, 258 aa, Artificial Sequence
  Synthetic Polypeptide
INIYNAEPANPSEKNSPEFQIVLTQSPATLSASPGEKATMTCSASSGVNYMHWYQQKPGTSPKRWIYDTDKTASGVPARFSGSGSGTSYSLTISSMEAEDAATYYCHQRGSYTFGGGTKLEIKGGGGSGGGGSGGGGSQVQLEQPGAEVVKPGASVKVSCKTSGYTFTSNWMHWVKQTPGKGLEWIGEIDPSDSYTNYNQKFDGKAKLTVDKSSSTAYMEVSDLTAEDSATYYCARGSNPYYYAMDYWGQGTSVTVSS

SEQ ID NO: 4567 - protein, 244 aa, Artificial Sequence
  Synthetic Polypeptide
DIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRGGGGSGGGGSGGGGSQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSS

SEQ ID NO: 4568 - protein, 252 aa, Artificial Sequence
  Synthetic Polypeptide
DDIQLTQSPSSLSASVGDRVTITCKASQSVDYDGDSYLNWYQQIPGKAPKLLIYDASNLVSGIPPRFSGSGSGTDYTFTISSLQPEDIATYHCQQSTEDPWTFGGGTKLQIKRGGGGSGGGGSGGGGSQVQLQQSGAEVKKPGSSVKVSCKASGYAFSSYWMNWVRQRPGQGLEWIGQIWPGDGDTNYNGKFKGRATITADESTNTAYMELSSLRSEDTAFYSCARRETTTVGRYYYAMDYWGQGTTVTVSS

SEQ ID NO: 4569 - protein, 243 aa, Artificial Sequence
  Synthetic Polypeptide
QSVLTQPASVSGSPGQSITISCTGTSSDVGGYNYVSWYQQHPGKAPKLMIYDVNNRPSEVSNRFSGSKSGNTASLTISGLQAEDEADYYCSSYTTGSRAVFGGGTKLTVLGGGGGSGGGGSGGGGSEVQLVQSGAEVKKPGESLTISCKASGYSFPNYWITWVRQMSGGGLEWMGRIDPGDSYTTYNPSFQGHVTISIDKSTNTAYLHWNSLKASDTAMYYCARYYVSLVDIWGQGTLVTVSS

SEQ ID NO: 4570 - protein, 249 aa, Artificial Sequence
  Synthetic Polypeptide
QSVVTQPPSVSAAPGQKVTISCSGSSSNIGNNYVSWYQQLPGTAPKLLIYDNNKRPSGIPDRFSGSKSGTSATLGITGLQTGDEADYYCGTWDGSLYTMLFGGGTKLTVLGGGGSGGGGSGGGGSEVQLVESGGGLVKPGGSLRLSCAASGFTFSNAWMSWVRQAPGKGLEWVGFIRSKAYGGTTEYAASVKGRFTISRDDSKSIAYLQMNNLKTEDTAVYYCARDGLYSSSWYDSDYWGQGTLVTVSS

SEQ ID NO: 4571 - protein, 254 aa, Artificial Sequence
  Synthetic Polypeptide
QSVLTQPPSVSGAPGQRVTISCTGSSSNIGAGYDVHWYQQLPGTAPKLLIFGNSNRPSGVPDRFSGFKSGTSASLAITGLQAEDEADYFCQSYDSSLSGSGVFGTGTKVTVLGGGGGSGGGGSGGGGSQMQLVQSGGGLVQPGRSLRLSCAASGFTFDDYAMHWVRQAPGKGLEWVSGISWNSGSIGYADSVKGRFTISRDNAKNSLYLQMNSLRAEDTALYYCAKDIHSGSYYGLLYYAMDVWGQGTTVTVSS

SEQ ID NO: 4572 - protein, 240 aa, Artificial Sequence
  Synthetic Polypeptide
YIHVTQSPSSLSVSIGDRVTINCQTSQGVGSDLHWYQHKPGRAPKLLIHHASSVEDGVPSRFSGTGFHTSFNLTINDLQADDIGTYYCQVLQSFGRGSRLDTKGGGGSGGGGSGGGGSRAHLVQSGTAMKKPGASVRVSCQTSGYTFTAHILFWFRQAPGRGLEWVGWIKPQYGAVNFGGGFRDRVTLTRDVYREIAYMDIRGLKPDDTAVYYCARDRSYGDSSWALDAWGQGTTVVVSA

SEQ ID NO: 4573 - protein, 251 aa, Artificial Sequence
  Synthetic Polypeptide
DVQMIQTPDSLAVSLGQRATISCRASESVDNYGISFMHWYQQKPGQSPKLLIYRASNLESGIPARFSGSGSRTDFTLTINPVETDDVATYYCQQNNKDPPTFGGGTKLEIKGGGGSGGGGSGGGGSGGGGSQVQLQQSGAELVKPGASVKISCKASGYAFSSYWMNWVKQRPGKGLEWIGQIYPGDGDTTYNGKFKGKATLTADKSSSTVYMQLNSLTSEDSAVYFCVRYYYGSSGYFDYWGQGTTLTVSS

SEQ ID NO: 4574 - protein, 242 aa, Artificial Sequence
  Synthetic Polypeptide
DVQMIQTPSSLSASLGDRVTISCRASQDIGNYLNWYQQKPDGTVKLLIYYTSRLHSGVPSRFSGSGSGTEYSLTISNLEQEDIATYFCQQGSALPPTFGGGTKLEINGGGGSGGGGSGGGGSALQLQQSGAELVRPGASVTLSCKASGYTFTDYEMHWVKQTPVHGLEWIGAIDPETGGTAYNQKFEGKAILTADKSSSTAYMELRSLTSEDSPVYYCARRRYYGSSSFDYWGQGTTLTVSS

SEQ ID NO: 4575 - protein, 250 aa, Artificial Sequence
  Synthetic Polypeptide
DVVMTQSPLSLPVTPGAPASISCRSSQSIVHSNGNTYLEWYLQKPGQSPKLLIYKVSNRFSGVPDRFSGSGSGTDFTLRISRVEAEDVGIYYCFQGSHVPPTFGPGTKLEIKGGGGSGGGGSGGGGSEVQLVESGGGLVQPGGSLRLSCSASGFTFSSFGMHWVRQAPGKGLEWVAYISSGSSTIYYGDTVKGRFTISRDNAKNSLFLQMSSLRAEDTAVYYCAREGGYYYGRSYYTMDYWGQGTTVTVS

SEQ ID NO: 4576 - protein, 246 aa, Artificial Sequence
  Synthetic Polypeptide
DIVLTQSPASLAVSLGQRATISCRASKSVSTSGYSYLHWYQQKPGQPPKLLIYLASNLESGVPARFSGSGSGTDFTLNIHPVEEEDAATYYCQHSRELPFTFGSGTKLEIKGGGGSGGGGSGGGGSQVQLVESGGGLVQPGGSLKLSCAASGFDFSRYWMSWVRQAPGKGLEWIGEINPTSSTINFTPSLKDKVFISRDNAKNTLYLQMSKVRSEDTALYYCARGNYYRYGDAMDYWGQGTSVTVS

SEQ ID NO: 4577 - protein, 244 aa, Artificial Sequence
  Synthetic Polypeptide
DIQMTQSPSSLSASVGDRVTITCSASQDISNYLNWYQQKPGKAPKLLIYYTSNLHSGVPSRFSGSGSGTDFTLTISSLQPEDFATYYCQQYRKLPWTFGQGTKLEIKRGGGGSGGGGSGGGGSQVQLVQSGAEVKKPGSSVKVSCKASGGTFSNYWMHWVRQAPGQGLEWMGATYRGHSDTYYNQKFKGRVTITADKSTSTAYMELSSLRSEDTAVYYCARGAIYDGYDVLDNWGQGTLVTVSS

SEQ ID NO: 4578 - protein, 244 aa, Artificial Sequence
  Synthetic Polypeptide
DIVLTQSPATLSLSPGDRATISCRASESVTILGSHLIYWYQQKPGQPPRLLIQLASNVQTGVPARFSGSGSRTDFTLTISSVEPEDFAVYYCLQSRTIPRTFGQGTKLEIKRGGGGSGGGGSGGGGSQVQLVQSGPEVKKPGESVKISCKASGYTFRHYSMNWVKQAPGQGLKWMGRINTESGVPIYADDFKGRFSFTVDTSASTAYLEISSLTSEDTAVYFCSNDYLYSLDFWGQGTTLTVSS

SEQ ID NO: 4579 - protein, 245 aa, Artificial Sequence
  Synthetic Polypeptide
QSVLTQPPSVSGAPGQRVTISCTGSSSNIGAGFDVHWYQQLPGTAPKLLIYGNSNRPSGVPDRFSGSKSGTSASLAITGLQAEDEADYYCQSYDSSLSGYVFGTGTKVTVLGGGGGSGGGGSGGGGSQVQLVQSGAEVKKPGASVKVSCKASGYTFTDYYMHWVRQAPGQRLEWMGWINPNSGGTNYAQKFQDRITVTRDTSSNTGYMELTRLRSDDTAVYYCARSPYSGVLDKWGQGTLVTVSS

SEQ ID NO: 4580 - protein, 243 aa, Artificial Sequence
  Synthetic Polypeptide
QAVLTQPPSASGTPGQRVTISCSGSSSNIGSYTVSWYQQLPGTAPKFLIYSNNQRPSGVPDRFSGSKSGTSASLAISGLQSEDEADYYCAAWDDSLNGYVFGTGTKVTVLGGGGGSGGGGSGGGGSEVQLVQSGAEVKKPGESLKISCKGSGYDFTTYWIGWVRQMPGKGLEWMGIIYPGDSDTRYSPSVRGRVTISADKSINTAYLQWSSLEASDTAMYYCARMWTFSQDGWGQGTLVTVSS

SEQ ID NO: 4581 - protein, 254 aa, Artificial Sequence
  Synthetic Polypeptide
LPVLTQPPSASGTPGQRVTISCSGRSSNIGSNSVNWYRQLPGAAPKLLIYSNNQRPPGVPVRFSGSKSGTSASLAISGLQSEDEATYYCATWDDNLNVHYVFGTGTKVTVLGSRGGGGSGGGGSGGGGSLEMAQVQLVQSGAEVKKPGSSVKVSCKASGGTFSSYAISWVRQAPGQGLEWMGRIIPILGIANYAQKFQGRVTITADKSTSTAYMELSSLRSEDTAVYYCARGGYYSHDMWSEDWGQGTLVTVSS

SEQ ID NO: 4582 - protein, 243 aa, Artificial Sequence
  Synthetic Polypeptide
DIVLTQSPASLAVSLGERATINCRASESVSVIGAHLIHWYQQKPGQPPKLLIYLASNLETGVPARFSGSGSGTDFTLTISSLQAEDAAIYYCLQSRIFPRTFGQGTKLEIKGGGGSGGGGSGGGGSQVQLVQSGSELKKPGESVKISCKASGYTFTDYSINWVKQAPGQGLKWMGWINTETREPAYAYDFRGRFVFSLDTSASTAYLQISSLKAEDTAVYFCALDYSYAMDYWGQGTLVTVSS

SEQ ID NO: 4583 - protein, 244 aa, Artificial Sequence
  Synthetic Polypeptide
DIVLTQSPATLSLSPGDRATLSCRASESVTILGSHLIYWYQQKPGQAPRLLIQLASNVQTGIPARFSGSGSRTDFTLTISSLEPEDFAVYYCLQSRTIPRTFGQGTKLEIKRGGGGSGGGGSGGGGSQVQLVQSGSELKKPGESVKISCKASGYTFTHYSMNWVRQAPGQGLEWMGRINTETGEPLYADDFKGRFVFSLDTSASTAYLQISSLKAEDTAVYYCSNDYLYSLDYWGQGTLVTVSS

SEQ ID NO: 4584 - protein, 245 aa, Artificial Sequence
  Synthetic Polypeptide
DIVMTQSPDSLAVSLGERATINCKSSQSILYSSNQKNYLAWYQQKPGQSPKLLIYWASTRESGVPDRFSGSGSGTDFTLTISSLQAEDVAVYYCHQYISSYTFGQGTKLEIKGGGGSGGGGSGGGGSQVQLVQSGAEVKKPGASVKVSCKASGYTFASQWMHWMRQAPGQGLEWIGWINPGNVNTKYNEKFKGRATLTVDTSTNTAYMELSSLRSEDTAVYYCARSTWYRPLDYWGQGTLVTVSS

SEQ ID NO: 4585 - protein, 245 aa, Artificial Sequence
  Synthetic Polypeptide
DHIVLTQSPSSLSASLGDRVTISCRASQDISTYLNWYQQKPDGTVKLLIFYTSRLHAGVPSRFSGSGSGTHHSLTISNLEQEDIATYFCQQGNSLPFTFGSGTKLEIKRGGGGSGGGGSGGGGSQVQLKESGPELEKPGASVKISCKASGYSFTAYSMNWVKQNNGMSLEWIGSIDPYYGDTKYAQKFKGKATLTVDKASSTAYLQLKSLTSEDSAVYYCARRMITTGDWYFDVWGAGTTVTVSS

SEQ ID NO: 4586 - protein, 245 aa, Artificial Sequence; identical to SEQ ID NO: 4585
  Synthetic Polypeptide

SEQ ID NO: 4587 - protein, 244 aa, Artificial Sequence
  Synthetic Polypeptide
EIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKGGGGSGGGGSGGGGSEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSS

SEQ ID NO: 4588 - protein, 247 aa, Artificial Sequence
  Synthetic Polypeptide
DIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKRGGGGSGGGGSGGGGSQVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSS

SEQ ID NO: 4589 - protein, 248 aa, Artificial Sequence
  Synthetic Polypeptide
DIQMTQSPSSLSASVGDRVTITCRSSQSIVHSVGNTFLEWYQQKPGKAPKLLIYKVSNRFSGVPSRFSGSGSGTDFTLTISSLQPEDFATYYCFQGSQFPYTFGQGTKVEIKRGGGGSGGGGSGGGGSEVQLVESGGGLVQPGGSLRLSCAASGYEFSRSWMNWVRQAPGKGLEWVGRIYPGDGDTNYSGKFKGRFTISADTSKNTAYLQMNSLRAEDTAVYYCARDGSSWDWYFDVWGQGTLVTVSS

SEQ ID NO: 4590 - protein, 244 aa, Artificial Sequence
  Synthetic Polypeptide
DIVLTQSPAIITASPGEKVTMTCRASSSVNYMDWYQKKPGSSPKPWIYATSNLASGVPSRFSGSGSGTTYSMTISSLEAEDAATYYCQQWSFNPPTFGGGTKLEIKRGGGGSGGGGSGGGGSEVQLQQSGAELKKPGASVKVSCKASGYTFTSYNMHWVKQTPGQGLEWIGAIYPGNGDTSYNQKFKGKTTLTADKSSSTAYMELSSLRSEDTAVYYCARSNYYGSSYWFFDVWGTGTTVTVSS

SEQ ID NO: 4591 - protein, 247 aa, Artificial Sequence
  Synthetic Polypeptide
EIVLTQSPATLSLSPGERATLSCRASQSVSSYLAWYQQKPGQAPRLLIYDASNRATGIPARFSGSGSGTDFTLTISSLEPEDFAVYYCQQRSDWPLTFGGGTKVEIKGGGGSGGGGSGGGGSEVQLVQSGGGLVHPGGSLRLSCTGSGFTFSYHAMHWVRQAPGKGLEWVSIIGTGGVTYYADSVKGRFTISRDNVKNSLYLQMNSLRAEDMAVYYCARDYYGAGSFYDGLYGMDVWGQGTTVTVSS

SEQ ID NO: 4592 - protein, 245 aa, Artificial Sequence
  Synthetic Polypeptide
EIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGGGTKVEIKGGGGSGGGGSGGGGSAVQLVESGGGLVQPGRSLRLSCAASGFTFGDYTMHWVRQAPGKGLEWVSGISWNSGSIGYADSVKGRFTISRDNAKNSLYLQMNSLRAEDTALYYCTKDNQYGSGSTYGLGVWGQGTLVTVSS

SEQ ID NO: 4593 - protein, 244 aa, Artificial Sequence
  Synthetic Polypeptide
DIQMTQSPSSLSASVGDRVTITCRASSSVSYMHWYQQKPGKAPKPLIYAPSNLASGVPSRFSGSGSGTDFTLTISSLQPEDFATYYCQQWSFNPPTFGQGTKVEIKRGGGGSGGGGSGGGGSEVQLVESGGGLVQPGGSLRLSCAASGYTFTSYNMHWVRQAPGKGLEWVGAIYPGNGDTSYNQKFKGRFTISVDKSKNTLYLQMNSLRAEDTAVYYCARVVYYSNSYWYFDVWGQGTLVTVSS

SEQ ID NO: 4594 - protein, 242 aa, Artificial Sequence
  Synthetic Polypeptide
DIQLTQSPSSLSASVGDRVTMTCRASSSVSYIHWFQQKPGKAPKPWIYATSNLASGVPVRFSGSGSGTDYTFTISSLQPEDIATYYCQQWTSNPPTFGGGTKLEIKGGGGSGGGGSGGGGSQVQLQQSGAEVKKPGSSVKVSCKASGYTFTSYNMHWVKQAPGQGLEWIGAIYPGNGDTSYNQKFKGKATLTADESTNTAYMELSSLRSEDTAFYYCARSTYYGGDWYFDVWGQGTTVTVSS

SEQ ID NO: 4595 - protein, 254 aa, Artificial Sequence
  Synthetic Polypeptide
STVMTQSPDSLAVSLGERATINCKSSQSNSNDVAWYQQKPGQSPKVLIYFASNRYSGVPDRFSGSGYGTDFTLTISSLQAEDVAVYFCQQDYSSPLTFGAGTKLELKRADAGGGGSGGGGSGGGGSQIQLVQSGSELKKPGASVKVSCKASGYTFTNFGVNWVRQAPGKGLEWMGWINTYTGEPSYAQGFTGRFVFSLDASVSTAYLQISSLKAEDTATYFCTRRTNYYGTSYYYAMDYWGQGTTVTVSSAKTT

SEQ ID NO: 4596 - protein, 246 aa, Artificial Sequence
  Synthetic Polypeptide
QIVLSQSPAILSASPGEKVTMTCRASSSVSYMHWYQQKPGSSPKPWIYATSNLASGVPARFSGSGSGTSYSFTISRVEAEDAATYYCQQWTFNPPTFGGGTRLEIKRTVAAGGGGSGGGGSGGGGSQAYLQQSGAELVRPGASVKMSCKASGYTFTSYNMHWVKQTPRQGLEWIGGIYPGNGDTSYNQKFKGKATLTVGKSSSTAYMQLSSLTSEDSAVYFCARYDYNYAMDYWGQGTSVTVSSAS

SEQ ID NO: 4597 - protein, 244 aa, Artificial Sequence; identical to SEQ ID NO: 4593
  Synthetic Polypeptide

SEQ ID NO: 4598 - protein, 243 aa, Artificial Sequence
  Synthetic Polypeptide
EIVLTQSPSSLSASVGDRVTITCRASSSLSFMHWYQQKPGKAPKPWIYATSNLASGVPSRFSGSGSGTDYTLTISSLQPEDFATYFCHQWSSNPLTFGGGTKVEIKGGGGSGGGGSGGGGSQVQLVQSGAEVKKPGASVKVSCKASGYTFTSYNMHWVRQAPGQRLEWIGAIYPGNGDTSYNQKFKGRVTVTRDTSANTAYMELSSLKSEDTAVYYCARSHYGSNYVDYFDYWGQGTLVTVSS

SEQ ID NO: 4599 - protein, 245 aa, Artificial Sequence
  Synthetic Polypeptide
DEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKGGGGSGGGGSGGGGSEVQLVESGGGLVQPDRSLRLSCAASGFTFHDYAMHWVRQAPGKGLEWVSTISWNSGTIGYADSVKGRFTISRDNAKNSLYLQMNSLRAEDTALYYCAKDIQYGNYYYGMDVWGQGTTVTVSS

SEQ ID NO: 4600 - protein, 262 aa, Artificial Sequence
  Synthetic Polypeptide
DEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKGGGGSGGGGSGGGGSFEAEPANPSEKNSPGGSEVQLVESGGGLVQPDRSLRLSCAASGFTFHDYAMHWVRQAPGKGLEWVSTISWNSGTIGYADSVKGRFTISRDNAKNSLYLQMNSLRAEDTALYYCAKDIQYGNYYYGMDVWGQGTTVTVSS

SEQ ID NO: 4601 - protein, 243 aa, Artificial Sequence
  Synthetic Polypeptide
EIVLTQSPGTLSLSPGERATLSCRASSSVPYIHWYQQKPGQAPRLLIYATSALASGIPDRFSGSGSGTDFTLTISRLEPEDFAVYYCQQWLSNPPTFGQGTKLELKRGGGGSGGGGSGGGGSEVQLVQSGAEVKKPGESLKLSCKGSGRTFTSYNMHWVRQMPGKGLEWMGAIYPLTGDTSYNQKSKLQVTISADKSISTAYLQWSSLKASDTAMYYCARSTYVGGDWQFDVWGKGTTVTVSS

SEQ ID NO: 4602 - protein, 240 aa, Artificial Sequence
  Synthetic Polypeptide
DIVMTQSPSSLSASVGDRVTITCKASQSVTNDVAWYQQKPGKAPKLLIYYASNRYTGVPSRFSGSGSGTDFTLTISSLQPEDFATYYCQQDYRSPWTFGGGTKVEIKRGGGGSGGGGSGGGGSQVQLEESGGGVVRPGRSLRLSCAASGFTFSDYGVNWIRQAPGKGLEWVTIIWGDGRTDYNSALKSRFTVSRNNSNNTLSLQMNSLTTEDTAVYYCVRAPGNRAMEYWGQGVLVTVSS

SEQ ID NO: 4603 - protein, 246 aa, Artificial Sequence
  Synthetic Polypeptide
DIQMTQSPSSLSASVGDRVTITCRASQTIWSYLNWYQQRPGKAPNLLIYAASSLQSGVPSRFSGRGSGTDFTLTISSLQAEDFATYYCQQSYSIPQIFGQGTKLEIKGGGGSGGGGSGGGGSQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSS

SEQ ID NO: 4604 - protein, 246 aa, Artificial Sequence
  Synthetic Polypeptide
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSGGGGSGGGGSGGGGSDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQIFGQGTKLEIK

SEQ ID NO: 4605 - protein, 239 aa, Artificial Sequence
  Synthetic Polypeptide
DIQMTQSPATIENTSLSASVGDRVTITCRASQGISSWLTWYQQKPEKAPKSLIYAASSLQSGVPSRFSGSGSGTDFTLTISSLQPEDFATYYCQQYDSYPITFGQGTRLEIKGGGGSGGGGSGGGGSQVQLQQWGAGLLKPSETLSLTCAVYGGSFSAYYWSWIRQPPGKGLEWIGDINHGGGTNYNPSLKSRVTISVDTSKNQFSLKLNSVTAADTAVYYCASLTAYWGQGSLVTVSS

SEQ ID NO: 4606 - protein, 243 aa, Artificial Sequence
  Synthetic Polypeptide
EIVLTQSPDSLAVSLGERATINCKASQSVDFDGDSYLNWYQQKPGQPPKVLIYAASTLQSGVPSRFSGSGSGTDFTLTINSLEAEDAATYYCQQSNEDPWTFGGGTKVEIKGGGGSGGGGSGGGGSQVQLVQSGAEVKKPGASVKVSCKVSGYTFTDYYITWVRQAPGQALEWMGWIYPGSGNTKYSQKFQGRFVFSVDTSASTAYLQLSSLKAEDTAVYYCANYGNYWFAYWGQGTLVTVSS

SEQ ID NO: 4607 - protein, 241 aa, Artificial Sequence
  Synthetic Polypeptide
DIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKGGGGSGGGGSGGGGSEVQLVQSGGGLVHPGGSLRLSCAGSGFAFSSSTMHWIRQAPGKGLEWISLIGSGGGIYYGDSVKGRFTISRDNAKNSLYLQMNSLRAEDMAVYYCVRGYFDWVDYFDYWGQGTLVTVSS

SEQ ID NO: 4608 - protein, 250 aa, Artificial Sequence
  Synthetic Polypeptide
DIVMTQSPDSLTVSLGERTTINCKSSQSVLDSSKNKNSLAWYQQKPGQPPKLLLSWASTRESGIPDRFSGSGSGTDFTLTIDSLQPEDSATYYCQQSAHFPITFGQGTRLEIKGGGGSGGGGSGGGGSQVQLVQSGAEVKKPGASVKVSCKASGYTFTNYGMNWVKQAPGQGLKWMGWINTYTGEPTYADDFKGRVTMTSDTSTSTAYLELHNLRSDDTAVYYCARWSWSDGYYVYFDYWGQGTTVTVSS

SEQ ID NO: 4609 - protein, 246 aa, Artificial Sequence
  Synthetic Polypeptide
EIVLTQSPGSLAVSPGERVTMSCKSSQSVFFSSSQKNYLAWYQQIPGQSPRLLIYWASTRESGVPDRFTGSGSGTDFTLTISSVQPEDLAIYYCHQYLSSRTFGQGTKLEIKRGGGGSGGGGSGGGGSQVQLQQPGAEVVKPGASVKMSCKASGYTFTSYYIHWIKQTPGQGLEWVGVIYPGNDDISYNQKFQGKATLTADKSSTTAYMQLSSLTSEDSAVYYCAREVRLRYFDVWGQGTTVTVSS

SEQ ID NO: 4610 - protein, 273 aa, Artificial Sequence
  Synthetic Polypeptide
YINIYNAEPANPSEKNSPTQYAYGSGEFDIQLTQSPSSLSASVGDRVTITCRASQGISSVLAWYQQKPGKAPKLLIYDASSLESGVPSRFSGSGSGTDFTLTISSLQPEDFATYYCQQFNSSITFGQGTKLEIKRTVAAGGGGSGGGGSGGGGSQVQLVQSGAEVKKPGSSVKVSCKASGGTFSDYAISWVRQAPGQGLEWMGRIIPILGVANYAQKFQGRVTITADKSTRTAYMELSSLRSEDTAVYYCARNWADAFDIWGQGTMVTVSSAS

SEQ ID NO: 4611 - protein, 272 aa, Artificial Sequence
  Synthetic Polypeptide
YINIYNAEPANPSEKNSPTQYAYGSGEFDIVMTQSPSSLSASLGGKVTITCKASQDINKYIAWYQHKPGKGPRLLIHYTSTLQPGIPSRFSGSGSGRDYSFSISNLEPEDIATYYCLQYDNLLTFGAGTKLELKRGGGGSGGGGSGGGGSEVKLQQSGPELVKPGTSVKVSCKASGYSFTDYNMYWVKQSHGKSLEWIGYIDPYKGGTIYNQKFKGKATLTVDKSSSTAFMHLNSLTSEDSAVYYCAREMITAYYFDYWGQGSSVTVSSLER

SEQ ID NO: 4612 - protein, 239 aa, Artificial Sequence
  Synthetic Polypeptide
DIQMTQSPSSLSASVGDRVTINCKASQDINSYLSWFQQKPGKAPKTLIYRANRLVDGVPSRFSGSGSGQDYTLTISSLQPEDFATYYCLQYDEFPLTFGGGTKVEIKGGGGSGGGGSGGGGSQVQLVQSGAEVKKPGASVKVSCKASGYTFTNYDINWVRQAPGQGLEWIGWIYPGDGSTKYNEKFKAKATLTADTSTSTAYMELRSLRSDDTAVYYCASGYEDAMDYWGQGTTVTVSS

SEQ ID NO: 4613 - protein, 244 aa, Artificial Sequence
  Synthetic Polypeptide
EIVLTQSPLSLPVTPGEPASISCRSSQSLLHSNGYNYLDWYLQKPGQSPQLLIYLGVNSVSGVPDRFSGSGSGTDFTLKISRVEAEDVGVYYCMQALQTPWTFGQGTKVEIKGGGGSGGGGSGGGGSQVQLVQSGAEVKKPGSSVKVSCKASGGIFSNHAISWVRQAPGQGLEWMGGIIPIFGTANYAQKFQGRVTITADESTSTAFMELSSLRSEDTAVYYCAREWADVFDIWGQGTMVTVSS

SEQ ID NO: 4614 - protein, 243 aa, Artificial Sequence
  Synthetic Polypeptide
DIQMTQSPASLTVSLGQRATISCRASESVDSYGNSYLHWYQQKPGQPPQLLIYLASNLESGVPARFSGSGSRTDFTLTIDPVEADDAATYYCQQNNEDPWTFGGGTKVEIKGGGGSGGGGSGGGGSEVQLQQSGAELVKPGASVKMSCKAFGYTFTTFPIEWMKQSHGKSLEWIGNFHPYNDQTKYNEEFKGRAKLTIDRSSSTVYLELGRLTSDDSAVYYCARGYYYAFDFWGQGTTLTVSS

SEQ ID NO: 4615 - protein, 240 aa, Artificial Sequence
  Synthetic Polypeptide
DIQMTQSPSSLSASVGDRVTITCRASQGIRNDLGWYQQKPGKAPKRLIYAASSLQSGVPSRFSGSGSGTEFTLTISSLQPEDFATYYCLQHNSYPWTFGQGTKLEIKGGGGSGGGGSGGGGSEVQLVESGGALIQPGGSLRLSCVASGFTISGNYMSWVRQAPGKGLEWVSLIYSGDSTYYADSVKGRFTISRDISKNTVYLQMNSLRVEDTAVYYCVRDGYYVSDMVVWGKGTTVTVSS

SEQ ID NO: 4616 - protein, 250 aa, Artificial Sequence
  Synthetic Polypeptide
DVLLTQSPLSLPVTLGQPASISCRSSQTIVHSNGNTYLEWFQQRPGQSPRLLIYQVSNRFSGVPDRFSGSGSGTDFTLKISRVEAEDVGVYYCFQGSHVPRTFGGGTKVEIKRGGGGSGGGGSGGGGSQIQLVQSGSELKKPGASVKVSCKASGYTFTNYGMNWVRQAPGQGLKWMGWINTNTGEPKYAEEFKGRFALSLDTSVSTAYLQINSLKAEDTAVYFCARGYGNYARGAWLAYWGQGTLVTVSS

SEQ ID NO: 4617 - protein, 236 aa, Artificial Sequence
  Synthetic Polypeptide
EIVLTQSPATLSLSPGERATLSCSASSSINYIYWLQQKPGQAPRILIYLTSNLASGVPARFSGSGSGTDFTLTISSLEPEDFAVYYCLQWSSNPLTFGGGTKVEIKGGGGSGGGGSGGGGSFEVQLVESGGGLVKPGGSLRLSCAASGFTFSSYDMSWVRQAPGKGLEWVSTISSGGSYTYYLDSIKGRFTISRDNAKNSLYLQMNSLRAEDTAVYYCARQGLDYWGRGTLVTVSS

SEQ ID NO: 4618 - protein, 245 aa, Artificial Sequence
  Synthetic Polypeptide
DIVMTQSPDSLAVSLGERATINCRASKSVSTSGYSFMHWYQQKPGQPPKLLIYLASNLESGVPDRFSGSGSGTDFTLTISSLQAEDVAVYYCQHSREVPWTFGQGTKVEIKRGGGGSGGGGSGGGGSQVQLVQSGAEVKKPGASVKVSCKASGYTFTNYGMNWVRQAPGQGLEWMGWINTYTGEPTYADAFKGRFAFSLDTSTSTAYLQINSLRSDDTAVYYCARDYGDYGMDYWGQGTTVTVSS

SEQ ID NO: 4619 - protein, 241 aa, Artificial Sequence
  Synthetic Polypeptide
DIVMTQTPLTLSVTIGQPASISCKSSQSLLDSDGKTYLNWLLQRPGQSPERLIYLVSKLDSGVPDRFTGSGSGTDFTLKISRVEAEDLGVYCCWQGTHFPYTFGGGTKVEIKGGGGGSGGGGSGGGGSQVQLQQPGAELVRPGASVKLSCKASGYTFTSYWMNWVKQRPGQGLEWIGMIDPSDSETHYNHIFKDKATLTVDKSSSTAYLQLSSLTSEDSAVYYCARNLYLWGQGTSVTVSS

SEQ ID NO: 4620 - protein, 241 aa, Artificial Sequence
  Synthetic Polypeptide
DIVMTQTPLSLSVTPGQPASISCKSSQSLLDGDGKTYLNWLLQKPGQSPQRLIYLVSKLDSGVPDRFSGSGSGTDFTLKISRVEAEDVGVYYCWQGTHFPRTFGQGTKLEIKGGGGSGGGGSGGGGSQVQLVQSGAEVKKPGASVKVSCKASGYTFKDTYIHWVRQAPGQGLEWMGRIDPANGNTKYDPKFQGRVTMTRDTSISTAYMELSRLRSDDTAVYYCARRGGVDWGQGTLVTVSS

SEQ ID NO: 4621 - protein, 249 aa, Artificial Sequence
  Synthetic Polypeptide
DIVMTQSPDSLAVSLGERATINCESSQSLLNSGNQKNYLTWYQQKPGQPPKPLIYWASTRESGVPDRFSGSGSGTDFTLTISSLQAEDVAVYYCQNDYSYPYTFGQGTKLEIKRGGGGSGGGGSGGGGSEVQLVQSGAEVKKPGESLKISCKGSGYSFTDYYMKWARQMPGKGLEWMGDIIPSNGATFYNQKFKGQVTISADKSISTTYLQWSSLKASDTAMYYCARSHLLRASWFAYWGQGTMVTVSS

SEQ ID NO: 4622 - protein, 244 aa, Artificial Sequence
  Synthetic Polypeptide
DIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKGGGGSGGGGSGGGGSQIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSS

SEQ ID NO: 4623 - protein, 248 aa, Artificial Sequence
  Synthetic Polypeptide
DFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKGGGGSGGGGSGGGGSEVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSS

SEQ ID NO: 4624 - protein, 248 aa, Artificial Sequence
  Synthetic Polypeptide
DFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKGGGGSGGGGSGGGGSQVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSS

SEQ ID NO: 4625 - protein, 242 aa, Artificial Sequence
  Synthetic Polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQDYGFPWTFGQGTKVEIKRGGGGSGGGGSGGGGSEVQLVQSGAEVKKPGESLKISCKGSGYSFTSYWISWVRQMPGKGLEWMGIIDPSDSDTRYSPSFQGQVTISADKSISTAYLQWSSLKASDTAMYYCARGDGSTDLDYWGQGTLVTVSS

SEQ ID NO: 4626 - protein, 244 aa, Artificial Sequence
  Synthetic Polypeptide
QFVLTQPPSVSTNPGSTVKLSCKRNTGNIGSNYVNWYQQKPGQSPTTMIYRDDKRPDGVPDRFSGSIDRSSNSALLTINNVQTEDEADYFCQSYSSGINIIFGGGTKLTVLGGGGSGGGGSGGGGSQVQLQESGPGLVKPSETLSLTCTVSGFSLTTYDVHWVRQPPGKGLEWMGRIQNAGITDYNSALKSRLIISRDTSKSQVFLKMNSVTTADTAMYFCAKTGSYFYAFDHWGQGTLVTVSS

SEQ ID NO: 4627 - protein, 241 aa, Artificial Sequence
  Synthetic Polypeptide
DIQMTQSPASLSASLGETVTIECRPSEDIHSNVAWYQQKPGNSPQLLIYDASNLADGVPSRFSGSGSGTQYSLKINSLQSEDVASYFCHQYNIYPYTFGSGTKLELKGGGGSGGGGSGGGGSQVQLQESGPTLVKPGDSVKMSCKASGYTFTDYIIHWVKQSHGKSLEWIGYINPYSDGTNYNEKFKSKATLTVDKSTSTAYMEFSRLTSEDSAIYFCALNYGSYYAMDAWGQGTSVTVSS

SEQ ID NO: 4628 - protein, 242 aa, Artificial Sequence
  Synthetic Polypeptide
EIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGQGTKVEIKRGGGGSGGGGSGGGGSEVQLLESGGGLVQPGGSLRLSCAASGFTFSGYWMHWVRQAPGKGLEWVSAIRSDGSSKYYADSVKGRFTISRDNSKNTLYLQMNSLRAEDTAVYYCAKDGVIEDTFDYWGQGTLVTVSS

SEQ ID NO: 4629 - protein, 238 aa, Artificial Sequence
  Synthetic Polypeptide
DVQITQSPSYLAASPGETITINCRASKSISKDLAWYQEKPGKTNKLLIYSGSTLQSGIPSRFSGSGSGTDFTLTISSLEPEDFAMYYCQQHNKYPYTFGGGTKLEIKRGGGGSGGGGSGGGGSQVQLQQPGAELVRPGASVKLSCKASGYTFTSYWMNWVKQRPDQGLEWIGRIDPYDSETHYNQKFKDKAILTVDKSSSTAYMQLSSLTSEDSAVYYCARGNWDDYWGQGTTLTVSS

SEQ ID NO: 4630 - protein, 269 aa, Artificial Sequence
  Synthetic Polypeptide
YINIYNAEPANPSEKNSPTQYAYGSGEFDIQMTQSPASLSASLGETVTIECRTSKDIYSNLAWFQQEPGNSPQLLIYDASNLADGVPSRFSGSGSGTQYSLQINNLQSEDVASYFCHQYNNYPYTFGTGTKLELKGGGGSGGGGSGGGGSQVQLQESGPTLVNPGDSVKMSCKASGYTFTDHIIHWVKQSHGKSLEWIGYINPYSGGANYNGKFKSKATLTIDKSSSTAYMEFSRLTSGDSAIYYCALNYGSYYAMDAWGQGTSVTVSS

SEQ ID NO: 4631 - protein, 240 aa, Artificial Sequence
  Synthetic Polypeptide
EIVLTQSPTSMTASPGEQVTITCRASSSINYMHWYQQKPGASPRPWIYETSKLASGVPDRFSGSASGTSYSLTINNMEAEDAATYYCQQWNYPSWTFGGGTKLELKGGGGSGGGGSGGGGSEVQLVESGGGLVQPGRSLKLSCAASGFTFSDYNMAWVRQAPKKGLEWVATILYDGGRTYYRGSVKGRFTISRDNAKSTLYLRMDSLRSEDTATYYCATHSRGTDYFDYWGQGVMVTVSS

SEQ ID NO: 4632 - protein, 249 aa, Artificial Sequence
  Synthetic Polypeptide
DIVMTQSPSSLAVSEGETVTINCKSSQSFLSSGDGKNYVAWYQYKPGQSPKLLIYWASTRQSGVPDRFIGSGSGTDFTLTISTVQAEDLAIYYCQQYYDTPLTFGSGTKLEIKGGGGSGGGGSGGGGSEVKLQESGPSLVQSSQTLSLTCTVSGFSLTSYHIHWVRQTPGKGLEWMGVMWSDGDTSYNSALKSRLSISRDTSQSQVFLKMNSLQTEDTATYYCARGYYSSYLYLWFAYWGQGTLVTVSS

SEQ ID NO: 4633 - protein, 253 aa, Artificial Sequence
  Synthetic Polypeptide
DVLMTQTPVSLPVSLGGQVSISCRSSQSLVHSDGDTYLHWYLQKPGQSPQLLIYRVSNRFSGVPDRFSGSGSGTDFTLKISRVEPEDLGLYYCLQTTHFPPWTFGGGTKLEMKGGGGSGGGGSGGGGSQVQLQQSGPELRRPGSSVRLSCKASGYRIKDFLIHWIKNRPEHGLEWIGWIDPEDGETKYAQKFQTKATLTADTSSNTAYMQLSSLTSEDTATYFCARWGDVYYGLMRGHVMDAWGQGTSVTVSS

SEQ ID NO: 4634 - protein, 244 aa, Artificial Sequence
  Synthetic Polypeptide
DIQMTQSTSSLSASLGDRVTISCSASQGINNYLNWYQQKPDGTVELLIYYTSTLQSGVPSRFSGSGSGTDYSLTISNLEPEDIGTYYCQQYSKLPRTFGGGTKLEIKGGGGSGGGGSGGGGSQVQLQQSGSELMMPGASVKISCKATGYTFSNYWIEWVKQRPGHGLEWIGEILPGTGRTIYNEKFKGKATFTADISSNTVQMQLSSLTSEDSAVYYCARRDYYGNFYYAMDYWGQGTSVTVSS

SEQ ID NO: 4635 - protein, 239 aa, Artificial Sequence
  Synthetic Polypeptide
DIQMTQSPASLSVSVGETVTITCRASENIYSNLAWYQQKQGKSPQLLVYAATNLADGVPSRFSGSGSGTQYSLKINSLQSEDFGSYYCQHFWGTWTFGGGTTLEIKGGGGSGGGGSGGGGSEVQLQQSGPELVKPGASVKMSCKASGYTFTDYYMKWMKQSHGKSLEWIGDINPNNGGTTYNQKFKGKATLTVDKSSSTAYMQLNSLTSEDSAVYYCARDYGYGYFDYWGQGTTLTVSS

SEQ ID NO: 4636 - protein, 242 aa, Artificial Sequence
  Synthetic Polypeptide
EIVLTQSPGTLSLSPGERATLSCRASQSVGGYLAWYQQKPGQAPRLLIYDASNRATGIPARFSGSGSGTDFTLTISSLEPEDFAVYYCQQRNNWPPMYTFGQGTKLEIKRGGGGSGGGGSGGGGSQVQLVQSGAEVKKPGSSVKVSCKASGGTFSSYAISWVRQAPGQGLEWMGGIIPILGTANYAQKFQGRVTITADESTSTAYMELSSLRSEDTAVYYCARWGGGAFDIWGQGTMVTVSS

SEQ ID NO: 4637 - protein, 237 aa, Artificial Sequence
  Synthetic Polypeptide
QIVLTQSPALMSASPGEKVTMTCSASSSVRYMYWYQQKPRSSPKPWIHLTSNLASGVPARFSGSGSGTSYSLTISSMEAEDAATYYCQQWSSHPFTFGSGTKLEIKGGGGSGGGGSGGGGSDVQLQESGPGLVKPSQSLSLTCTVTGFSITSDYSWNWIRQFPGNKLEWMGYISYSGHTSYNPSLESRISITRDTSKNQFFLQLNSVTTEDTATYYCTRGNWDVVYWGQGTLVTVSA

SEQ ID NO: 4638 - protein, 247 aa, Artificial Sequence
  Synthetic Polypeptide
DVVMTQSPLSLPVTLGQPASISCRSSQSIVHSDGNTYLEWYQQRPGQSPRRLIYKVSNRFSGVPDRFSGSGSGTDFTLKISRVEAEDVGVYYCFQGSHAPWTFGGGTKVEIKGGGGSGGGGSGGGGSEVQLVESGGGLVQPGGSLRLSCAASGFTFSSYGMHWVRQAPGKGLEWVAYITTRSSTIYYADSVKGRFTISRDNAKNSLYLQMNSLRAEDTAVYYCTREPLTGYYAMDYWGQGTSVTVSS

SEQ ID NO: 4639 - protein, 239 aa, Artificial Sequence
  Synthetic Polypeptide
DIQMTQSPSSLSASVGDRVTITCRASQSISLWLNWYQQKPGKAPKLLIYAASTLQSGVPSRFSGSGSGTDFTLTISSLQPEDFATYYCQQYYTSPYTFGQGTKVEIKRGGGGSGGGGSGGGGSQVQLLESGGGLVQPGGSLRLSCAASGFTFSSYAMSWVRQAPGKGLEWVSVIRSSGSSTYYADSVKGRFTISRDNSKNTLYLQMNSLRAEDTAVYYCARGGGYFDYWGQGTLVTVSS

SEQ ID NO: 4640 - protein, 242 aa, Artificial Sequence
  Synthetic Polypeptide
DIQMTQSPSSLSASVGDRVTITCRASQSISSYLNWYQQKPGKAPKLLIYAVSTLQSGVPSRFSGSGSGTDFTLTISSLQPEDFATYYCQQSGTFPPTTFGQGTKVEIKRGGGGSGGGGSGGGGSQVQLLESGGGLVQPGGSLRLSCAASGFTFSSHGMHWVRQAPGKGLEWVSVISGSGSNTGYADSVKGRFTISRDNSKNTLYLQMNSLRAEDTAVYYCARQWGSYAFDSWGQGTLVTVSS

SEQ ID NO: 4641 - protein, 252 aa, Artificial Sequence
  Synthetic Polypeptide
DIVMSQSPSSLAVSVGEKVTMSCKSSQSLLHSSNQKNYLAWYQQKPGQSPKVLIYWASTRESGVPDRFTGSGSGTDFTLTITSVKSEDLAVYYCQQYYSYPWTFGGGTRLEIKRGGGGSGGGGSGGGGSEVQLQQSVAELVKPGASVKMSCKVSGYTLTDHTIHWMKQRPEQGLEWIGYIYPRDGITGYNEKFKGKATLTADTSSSTAYMQLNSLTSEDSAVYFCARWGYSYRNYAYYYDYWGQGTTLTVSS

SEQ ID NO: 4642 - protein, 249 aa, Artificial Sequence
  Synthetic Polypeptide
EIVLTQSPGTLSLSPGERATLSCRASQSVSSSYLAWYQQKPGQAPRLLIYGTSSRATGIPDRFSGSGSGTDFTLTISRLEPEDFAVYYCQQYGSSPFTFGGGTKVEIKRGGGGSGGGGSGGGGSQVQLQESGPGLAKPSETLSLTCTVSGDSITSYYWSWIRQPPGKGLEWIGYIYYSGSTNYNPSLKSRVTISVDTSKNQFSLKLSSVTAADTAVYYCARDQRRIAAAGTHFYGMDVWGQGTTVTVSS

SEQ ID NO: 4643 - protein, 241 aa, Artificial Sequence
  Synthetic Polypeptide
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKGGGGSGGGGSGGGGSQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 4644 - protein, 234 aa, Artificial Sequence
  Synthetic Polypeptide
MTQSPKFLLVSAGDRVTLTCKASQSVNNDVYWYQQEPGQSPKLLIYWASTRESGVPDRFTGSGSGTDFTLTISSVQAEDLAVYYCKQSYNLYTFGGGTKLEIKRGGGGSGGGGSGGGGSESGRGLVQPGGSRKLSCAASGFTFSTSGMHWVRQAPEKGLEWVAYISSGSTTIYHADTVKGRFTISRDNPKNTLFLQMTSLRSEDTAMYYCCARSGQFGNYFDYWGQGTTLTVSS

SEQ ID NO: 4645 - protein, 239 aa, Artificial Sequence
  Synthetic Polypeptide
QSPSSLAVSAGEKVTMSCKSSQSLLNSRTRKNYLAWYQQKPGQSPKLLIYWASTRESGVPDRFTGSGSGTDFTLTISSVQAEDLAVYYCKQSNLYTFGGGTKLEIKGGGGSGGGGSGGGGSQVQLEESGPELVKPGASVKLSCKASGYTFTEYIIHWVKQRSGQGLEWIGWFYPGSGSIKYNEKFKDKATLTADKSSSTVYMELSGLTSEDSAVYFCARHDGYSYFDYWGQGTTLTVSS

SEQ ID NO: 4646 - protein, 242 aa, Artificial Sequence
  Synthetic Polypeptide
DIQMTQSPSSLSASLGERVSLTCRATQELSGYLSWLQQKPDGTIKRLIYAASTLDSGVPKRFSGNRSGSDYSLTISSLESEDFADYYCLQYAIYPYTFGGGTKLEIKGGGGSGGGGSGGGGSEVQLQQSGPELVKPGASVKMSCKASGYTFTSYFIHWVKQKPGQGLEWIGFINPYNDGSKYNEKFKGKATLTSDKSSSTAYMELSSLTSEDSAVYYCTRDDGYYGYAMDYWGQGTSVTVSS

SEQ ID NO: 4647 - protein, 247 aa, Artificial Sequence
  Synthetic Polypeptide
DTIVLTQSPASLAVSLGQRATISCRASESVDSYGNSFMHWYQQKPGQPPKLLIYLASNLESGVPARFSGSGSRTDFTLTIDPVEADDAATYYCQQNNYDPWTFGGGTKLEIKGGGGSGGGGSGGGGSEVQLQQSGPELVKPGASVKMSCKASGYTFTSYVMHWVKQKPGQGLEWIGYINPYNDGTKYNEKFKGKATLTSDTSSSTAYMELNSLTSEDSAVYFCARPIYFDNDYFDYWGQGTTLKVSS

SEQ ID NO: 4648 - protein, 242 aa, Artificial Sequence
  Synthetic Polypeptide
DIQMTQSPSSLSASVGDRVTITCKASQDVSTAVAWFQQKPGKAPKLLIYSPSYRYTGVPSRFSGSGSGTDFTLTISSLQPEDFTYYCQQLYSTPYTFGQGTKVEIKGGGGSGGGGSGGGGSEVQLVQSGAEVKKPGASVKVSCKASGYTFTDYYLDVVVRQAPGQGLEWIGRVNPYNGGTIYNQKFKGRVTLTRDTSTSTAYLELSSLRSEDTAVYYCARDHYRYDPLLDYWGQGTLVTVSS

SEQ ID NO: 4649 - protein, 248 aa, Artificial Sequence
  Synthetic Polypeptide
DIQMTQSPSSLSASVGDRVTITCRASQSVSTSSYNYMHWYQQKPGKPPKLLIKYASNLESGVPSRFSGSGSGTDFTLTISSLQPEDFATYYCQHSWEIPLTFGQGTKVEIKGGGGSGGGGSGGGGSEVQLVQSGAEVKKPGASVKVSCKASGYSFTDYYMHWVRQAPGQGLEWIGRINPYNGAAFYSQNFKDRVTLTVDTSTSTAYLELSSLRSEDTAVYYCAIERGADLEGYAMDYWGQGTLVTVSS

SEQ ID NO: 4650 - protein, 246 aa, Artificial Sequence
  Synthetic Polypeptide
EIVLTQSPATLSASPGERVTLTCRASSNVISSYVHWYQQKPGSSPRLFLYSTSNLASGVPSRFSGSGSGTDFTFTISSLEAEDAATYYCQQYSGYPLTFGQGTRLEIKGGGGSGGGGSGGGGSQVQLQESGPGLVKPSETLSLTCAVSGYSITSAYYWNWIRQPPGKGLEWIGYISYDGRNNYNPSLKNRITINPDTSKNQFSLQLNSVTPEDTAVYYCAREGDYDVGNYYAMDYWGQGTLVTVSS

SEQ ID NO: 4651 - protein, 246 aa, Artificial Sequence
  Synthetic Polypeptide
EIVLTQSPATLSLSPGERATLSCRASSNVISSYVHWYQQKPGQAPRLLIYSTSNLASGIPARFSGSGSGTDFTLTISSLEPEDFAVYYCQQYSGYPLTFGQGTRLEIKGGGGSGGGGSGGGGSEVQLVESGGGLVQPGRSLRLSCAASGYSITSAYYWNWVRQAPGKGLEWVSYISYDGRNNYNPSLKNRFTISRDNAKKSLYLQMNSLRAEDTALYYCAKEGDYDVGNYYAMDYWGQGTTVTVSS

SEQ ID NO: 4652 - protein, 258 aa, Artificial Sequence
  Synthetic Polypeptide
DLNFMLTQPHSVSGSPGKTVTISCTRSTGSITSNYVHWYQQRPGSSPTTVICEDNERPSGVPDRFSGSIDISSNSASLTISGLKTEDEADYYCQSYDDSNHISVFGTGTKVTVLGQPKANPGGGGSGGGGSGGGGSQVQLQESGPGLVKPSETLSLTCTVSGGSISSSNYYWGWIRQPPGKGLEWIGAIYYSGSTYYNPSLKSRVAISVDTSKNQFSLKLSSVTAADTAVYYCARRIGVAGQWYFDLWGRGTLVTVSS

SEQ ID NO: 4653 - protein, 244 aa, Artificial Sequence
  Synthetic Polypeptide
DIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIKGGGGSGGGGSGGGGSQIQLVQSGPDLKKPGETVKISCKASGYTFTNTGMNWVKQAPGKGLKWMGWINTYTGEPTYADDFKGRFTFSLETSASTAYLQINNLKNEDTATYFCTRWGYGSSLYYAMDYWGQGTSVTVSS

SEQ ID NO: 4654 - protein, 241 aa, Artificial Sequence
  Synthetic Polypeptide
DIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIKGGGGSGGGGSGGGGSEVQLVESGGGLVQPGGSLRLSCAASGFDFSRYWMSWVRQAPGKGLEWIGEINPDSSTINYAPSLKDKFIISRDNAKNSLYLQMNSLRAEDTAVYYCARPDGNYWYFDVWGQGTLVTVSS

SEQ ID NO: 4655 - protein, 242 aa, Artificial Sequence
  Synthetic Polypeptide
DIVMTQSQKSMSTSVGDRVSITCKASQDVITGVAWYQQKPGQSPKLLIYSASYRYTGVPDRFTGSGSGTDFTFTISNVQAEDLAVYYCQQHYSTPLTFGAGTKLELKGGGGSGGGGSGGGGSQVQLQQPGAELVRPGASVKLSCKASGYSFTTYWMNWVKQRPGQGLEWIGMIHPSDSETRLNQKFKDKATLTVDKSSSTAYMQLSSPTSEDSAVYYCARSTMIATRAMDYWGQGTSVTVSS

SEQ ID NO: 4656 - protein, 244 aa, Artificial Sequence
  Synthetic Polypeptide
DIQMTQSPSSLSASVGDRVTITCKASQDVSTAVAWYQQKPGKAPKLLIYSASYRYTGVPDRFTGSGSGTDFTLTISSLQPEDFATYYCQQHYSTPPYTFGGGTKVEIKRGGGGSGGGGSGGGGSQVQLVQSGAEVKKPGASVKVSCKASGYAFSSSWMNWVRQAPGQGLEWIGRIYPGDGDTKYNGKFKGKATLTADKSTSTAYMELSSLRSEDTAVYYCARSTMIATGAMDYWGQGTLVTVSS

SEQ ID NO: 4657 - protein, 245 aa, Artificial Sequence
  Synthetic Polypeptide
DVVMTQTPLSLSVTPGQPASISCRSSQSLVHNNGNTYLHWYLQKPGQSPQLLIYKVSNRFSGVPDRFSGSGSGTDFTLKISRVEAEDVGVYFCSQSTHVPPYTFGGGTKVEIKGGGGSGGGGSGGGGSEVQLVESGGGLVQPGGSLRLSCAASGFTFSDYYMAWVRQAPGKGLEWVAEINYDGSSTYYVDSVKGRFTISRDNAKNSLYLQMNSLRAEDTAVYYCARDRGFYFDYWGQGTTVTVSS

SEQ ID NO: 4658 - protein, 245 aa, Artificial Sequence
  Synthetic Polypeptide
DVVMTQTPLSLSVTPGQPASISCRSSQSLVHSNGLTYLHWYLQKPGQSPQLLIYKVSNRFSGVPDRFSGSGSGTDFTLKISRVEAEDVGVYFCSQSTHVPPFTFGGGTKVEIKGGGGSGGGGSGGGGSEVQLVESGGGLVQPGGSLRLSCAASGFTFSDYYMAWVRQAPGKGLEWVASINYDGESTYYVDSVKGRFTISRDNAKNSLYLQMNSLRAEDTAVYYCARDRGYYFDYWGQGTTVTVSS

SEQ ID NO: 4659 - protein, 245 aa, Artificial Sequence
  Synthetic Polypeptide
DVVMTQSPLSLPVTPGEPASISCRSSQSLVHSNGNTYLHWYLQKPGQSPQLLIYKVSNRFSGVPDRFSGSGSGTDFTLKISRVEAEDVGVYFCSQSTHVPPFTFGGGTKVEIKGGGGSGGGGSGGGGSEVQLVESGGGLVQPGGSLRLSCAASGFTFSDYYMAWVRQAPGKGLEWVADINYDGGSTYYLDSLKSRFTISRDNAKNSLYLQMNSLRAEDTAVYYCARDRGYYFDYWGQGTLVTVSS

SEQ ID NO: 4660 - protein, 243 aa, Artificial Sequence
  Synthetic Polypeptide
DIQMTQSSSYLSVSLGGRVTITCKASDHINNWLAWYQQKPGNAPRLLISGATSLETGVPSRFSGSGSGKDYTLSITSLQTEDVATYYCQQYWSTPWTFGGGTKLEIKGGGGSGGGGSGGGGSQVQLQQSGAELARPGASVKLSCKASGYTFTSYWMQWVKQRPGQGLEWIGAIYPGDGDTRYTQKFKGKATLTADKSSSTAYMQLSSLASEDSAVYYCARGKVYYGSNPFAYWGQGTLVTVSA

SEQ ID NO: 4661 - protein, 243 aa, Artificial Sequence
  Synthetic Polypeptide
DIVMTQSHKFMSTSVGDRVSITCKASQDVSTAVAWYQQKPGQSPKLLIYSASYRYTGVPDRFTGSGSGTDFTFTISSVQAEDLAVYYCQQHYSTPPYTFGGGTKLEIKGGGGSGGGGSGGGGSQVQLQQSGPELVKPGASVKISCKASGYAFSSSWMNWVKQRPGQGLEWIGRIYPGDGDTKYNGKFKGKATLTADKSSSTAYMQLSSLTSVDSAVYFCARSTMIATGAMDYWGQGTSVTVSS

SEQ ID NO: 4662 - protein, 248 aa, Artificial Sequence
  Synthetic Polypeptide
QSVLTQPPSVSGAPGQRVTISCTGSGSNIGAPYDVSWYQQLPGTAPKLLIYHNNKRPSGVPDRFSGSKSGTSASLAITGLQAEDEADYYCATVEAGLSGSVFGGGTKLTVLGAGGGGSGGGGSGGGGSQVQLVQSGAEVKKPGASVKVSCKVSGYTLTELSIHWVRQAPGKGLEWMGGFDPEENEIVYAQRFQGRVTMTEDTSTDTAYMELSSLRSEDTAVYYCAIVGSFSPLTLGLWGQGTMVTVSS

SEQ ID NO: 4663 - protein, 248 aa, Artificial Sequence
  Synthetic Polypeptide
QSVLTQPPSVSGAPGQRVTISCTGSGSNIGAPYDVSWYQQLPGTAPKLLIYHNNKRPSGVPDRFSGSKSGTSASLAITGLQAEDEADYYCQSYDSSSISTIFGGGTKLTVLGAGGGGSGGGGSGGGGSQVQLVQSGAEVKKPGASVKVSCKVSGYTLTELSIHWVRQAPGKGLEWMGGFDPEENEIVYAQRFQGRVTMTEDTSTDTAYMELSSLRSEDTAVYYCAIVGSFSGIAYRPWGQGTMVTVSS

SEQ ID NO: 4664 - protein, 246 aa, Artificial Sequence
  Synthetic Polypeptide
DIQMTQSPSSLSASVGDRVTITCSASSSVSYMYWYQQKPGKAPKLLIYLTSNLASGVPSRFSGSGSGTDFTLTISSLQPEDFATYYCQQWRSNPFTFGQGTKLEIKRGGGGSGGGGSGGGGSQITLKESGPTLVKPTQTLTLTCTFSGFSLSTSGMGVGWIRQPPGKALEWLAHIWWDDVKRYSPSLKSRLTITKDTSKNQVVLTMTNMDPVDTATYYCARIVSFDNDVVSAMDYWGQGTLVTVSS

SEQ ID NO: 4665 - protein, 241 aa, Artificial Sequence
  Synthetic Polypeptide
EIVMTQSPATLSVSPGERATLSCKASQSVSNDVVWYQQKPGQAPRLLIYYASNRYTGIPARFSGSGSGTEFTLTISSLQSEDFAVYYCQQDYTSPWTFGQGTKLEIKRGGGGSGGGGSGGGGSQVQLVQSGAEVKKPGASVKVSCKASGYTFTNYGMNWVRQAPGQGLEWMGWINTYTGEPTYADDFKGRVTMTTDTSTSTAYMELRSLRSDDTAVYYCARIGDSSPSDYWGQGTLVTVSS

SEQ ID NO: 4666 - protein, 241 aa, Artificial Sequence
  Synthetic Polypeptide
STDIQMTQSPSSLSASVGDRVTITCRASQSISSYLNWYQQKPGKAPKLLIYLASNLQSGVPSRFSGSGSGTDFTLTISSLQPEDFATYYCQQAEYMPLTFGQGTKVEIKRAGGGGSGGGGSGGGGSEVQLLESGGGLVQPGGSLRLSCAASGFTFSGYAMSWVRQAPGKGLEWVSEIAPPGLNTRYADSVKGRFTISRDNSKNTLYLQMNSLRAEDTAVYYCAKSDTAFDYWGQGTLVTVS

SEQ ID NO: 4667 - protein, 245 aa, Artificial Sequence
  Synthetic Polypeptide
DQAVLTQESALTTSPGETVTLTCRSSTGAVTTSNYANWVQEKPDHLFTGLIGGTNNRVPGVPARFSGSLIGDKAALTITGAQTEDEAIYFCVLWHSNHWVFGGGTKLTVLGGGGSGGGGSGGGGSDVQLVESGGGLVQPGGSRKLSCAASGFTFSSFGMHWVRQAPEKGLEWVAYISSGSSTLHYADTVKGRFTISRDNPKNTLFLQMTSLRSEDTAMYYCARWGNYPHYAMDYWGQGTSVTVSS

SEQ ID NO: 4668 - protein, 236 aa, Artificial Sequence
  Synthetic Polypeptide
DIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVEGGGGSGGGGSGGGGSEVQVLESGGGLVQPGGSLRLSCAASGFTFSSYAMSWVRQAPGKGLEWVSAISGSGGSTNYADSVKGRFTISRDNSKNTLYLQMNSLRAEDTAVYYCAGSSGWSEYWGQGTLVTVSS

SEQ ID NO: 4669 - protein, 241 aa, Artificial Sequence
  Synthetic Polypeptide
EIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSGGGGSGGGGSGGGGSDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIK

SEQ ID NO: 4670 - protein, 248 aa, Artificial Sequence
  Synthetic Polypeptide
ELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGGGGSGGGGSGGGGSEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSS

SEQ ID NO: 4671 - protein, 249 aa, Artificial Sequence
  Synthetic Polypeptide
ELQMTQSPSSLSASVGDRVTITCRASQSISSYLNWYQQKPGQPPKLLIYWASTRESGVPDRFSGSESGTNYTLTISSLQPEDFATYFCQQSDSLPITFGQGTRLDIQGGGGSGGGGSGGGGSEVQLLESGGGVVQPGRSLRLSCAASGFTFSSYGMHWVRQAPGKGLEWVAVISYDGSNKYYADSVKGRFTISRDNSKNTLYLQMNSLRAEDTAVYYCAKDMGWGSGWRPYYYYGMDVWGQGTTVTVSS

SEQ ID NO: 4672 - protein, 246 aa, Artificial Sequence
  Synthetic Polypeptide
DIQMTQSPSSLSASVGDRVTITCRASQSISSYLNWYQQKPGKAPKLLIYAASSLQSGVPSRFSGSGSGTDFTLTISSLQPEDLATYYCQQSYSTPFTFGPGTKVDIKGGGGSGGGGSGGGGSVHEVQLVQSGAEVKKPGSSVKVSCKASGGTFSSYAISWVRQAPGQGLEWMGGIIPIFGTANYAQKFQGRVTITADKSTSTAYMELSSLRSEDTAVYYCATFALFGFREQAFDIWGQGTTVTVSS

SEQ ID NO: 4673 - protein, 244 aa, Artificial Sequence
  Synthetic Polypeptide
DVVMTQTPLSLPVSLGDQASISCRSSQSLVHSNGNTYLRWYLQKPGQSPKVLIYKVSNRFSGVPDRFSGSGSGTDFTLKISRVEAEDLGVYFCSQSTHVPWTFGGGTKLEIKGGGGSGGGGSGGGGSEVKLDETGGGLVQPGRPMKLSCVASGFTFSDYWMNWVRQSPEKGLEWVAQIRNKPYNYETYYSDSVKGRFTISRDDSKSSVYLQMNNLRVEDMGIYYCTGSYYGMDYWGQGTSVTVS

SEQ ID NO: 4674 - protein, 255 aa, Artificial Sequence
  Synthetic Polypeptide
DVVMTQTPLSLPVSLGDQASISCRSSQSLVHSNGNTYLRWYLQKPGQSPKVLIYKVSNRVSGVPDRFSGSGSGTDFTLKINRVEAEDLGVYFCSQSTHVPWTFGGGTKLEIKSSADDAKKDAAKKDDAKKDDAKKDGGVKLDETGGGLVQPGGAMKLSCVTSGFTFGHYWMNWVRQSPEKGLEWVAQFRNKPYNYETYYSDSVKGRFTISRDDSKSSVYLQMNNLRVEDTGIYYCTGASYGMEYLGQGTSVTVST

SEQ ID NO: 4675 - protein, 251 aa, Artificial Sequence
  Synthetic Polypeptide
QVQLVESGGNLVQPGGSLRLSCAASGFTFGSFSMSWVRQAPGGGLEWVAGLSARSSLTHYADSVKGRFTISRDNAKNSVYLQMNSLRVEDTAVYYCARRSYDSSGYWGHFYSYMDVWGQGTLVTVSGGGGSGGGGSGGGGSSVLTQPSSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLG

SEQ ID NO: 4676 - protein, 246 aa, Artificial Sequence
  Synthetic Polypeptide
DIQMTQSPSSLSASVGDRVTITCRTSQSLSSYTHWYQQKPGKAPKLLIYAASSRGSGVPSRFSGSGSGTDFTLTISSLQPEDFATYYCQQSRTFGQGTKVEIKGGGGSGGGGSGGGGSQVQLQQSGPGLVKPSQTLSLTCAISGDSVSSYNAVWNWIRQSPSRGLEWLGRTYYRSGWYNDYAESVKSRITINPDTSKNQFSLQLNSVTPEDTAVYYCARSGHITVFGVNVDAFDMWGQGTMVTVSS

SEQ ID NO: 4677 - protein, 245 aa, Artificial Sequence
  Synthetic Polypeptide
DIVLTQSPLSLAVSLGQPAIISCKASQSVSFAGTSLMHWYHQKPGQQPRLLIYRASNLEAGVPDRFSGSGSKTDFTLTISPVEAEDAATYYCQQSREYPYTFGGGTKLEIKRGGGGSGGGGSGGGGSQVQLVQSGAEVVKPGASVKISCKASGYTFTGYFMNWVKQSPGQSLEWIGRIHPYDGDTFYNQKFQGKATLTVDKSSNTAHMELLSLTSEDFAVYYCTRYDGSRAMDYWGQGTTVTVSS

SEQ ID NO: 4678 - protein, 249 aa, Artificial Sequence
  Synthetic Polypeptide
DLETTLTQSPATLSVSPGERVTLSCRASQSVGSNLAWYQQKFGQAPRLLIYDASTRATGIPARFSGSGSGTEFTLTISRLEPEDFAVYYCHQYGSSPRTFGQGTKVDIKRGGGGSGGGGSGGGGSQVQLVQSGAEVKKPGASVKVSCKASGYTFTTYGISWVRQAPGQGLEWMGWISAYNGHTNYAQMLQGRVTMTTDTSTSTAYMELRGLRSDDTAVYYCAREAYASYGSGSYWTDYWGQGTLVTVSS

SEQ ID NO: 4679 - protein, 241 aa, Artificial Sequence
  Synthetic Polypeptide
DVVMTQTPLSLPVTPGEPASISCRSSQSLVHRNGNTYLHWYLQKPGQSPKLLIHKVSNRFSGVPDRFSGSGSGTDFTLKISRVEAEDLGVYFCSQSTHVPPLTFGAGTKLELKGGGGSGGGGSGGGGSEVQLVQSGAEVEKPGASVKISCKASGSSFTGYNMNWVRQNIGKSLEWIGAIDPYYGGTSYNQKFKGRATLTVDKSTSTAYMHLKSLRSEDTAVYYCVSGMEYWGQGTSVTVSS

SEQ ID NO: 4680 - protein, 239 aa, Artificial Sequence
  Synthetic Polypeptide
EIVMTQTPATLSVSAGERVTITCKASQSVSNDVTWYQQKPGQAPRLLIYSASNRYSGVPARFSGSGYGTEFTFTISSVQSEDFAVYFCQQDYSSFGQGTKLEIKRGGGGSGGGGSGGGGSQVQLVESGPGVVQPGRSLRISCAVSGFSVTNYGVHWVRQPPGKGLEWLGVIWAGGITNYNSAFMSRLTISKDNSKNTVYLQMNSLRAEDTAMYYCASRGGHYGYALDYWGQGTLVTVSS

SEQ ID NO: 4681 - protein, 242 aa, Artificial Sequence
  Synthetic Polypeptide
DIQMTQTASSLPASLGDRVTISCSASQDISNYLNWYQQKPDGTVKLLIFYSSNLHSGVPSRFSGGGSGTDYSLTISNLEPEDIATYFCHQYSKLPWTFGGGTKLEIKRGGGGSGGGGSGGGGSEVTLVESGGDFVKPGGSLKVSCAASGFAFSHYAMSWVRQTPAKRLEWVAYISSGGSGTYYSDSVKGRFTISRDNAKNTLYLQMRSLRSEDSAMYFCTRVKLGTYYFDSWGQGTTLTVSS

SEQ ID NO: 4682 - protein, 244 aa, Artificial Sequence
  Synthetic Polypeptide
QFVLTQSPSASAALGASAKLTCTLSSAHKTYTIDWYQQQKGKAPRYLIQVKSDGTYTKATGVPDRFSGSSSGADRYLIIPSVQADDEADYYCGTDYTGGYVFGGGTQLTVTGGGGSGGGGSGGGGSEQLKESGGGLFKPTDTLTLTCTVSGFSLSYYGVNWVRQAPGNGLEWIGTIGGSGDTYYASWAKSRSTIIRNTNENTVTLKMTSLTAADTATYFCVRYANIGYEYFNVWGPGTLVTVSS

SEQ ID NO: 4683 - protein, 249 aa, Artificial Sequence
  Synthetic Polypeptide
QFVLTQSPSVSAALGASAKLTCTLSSAHKTYTIDWYQQQQGEAPRYLMQVKSDGSYTKGTGVPDRFSGSSSGADRYLIIPSVQADDEAGYVCGADDNGGYVFGGGTQLTVTGGGGSGGGGSGGGGSQSVKESEGGLFKPTDTLTLTCTVSGFSLSRHALTWVRQAPGNGLEWIGAIDNAGTTYYASWAKSRSTITRNTDLHTVTLKMTSLTASDTATYFCARVFYDINSGYYLDGMDLWGPGTLVTVSS

SEQ ID NO: 4684 - protein, 243 aa, Artificial Sequence
  Synthetic Polypeptide
DIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKGGGGSGGGGSGGGGSEVQLVESGGGLVQPGESLRLSCVASGFTFSRYKMNWVRQAPGKGLEWVSYISRSGRDIYYADSVKGRFTISRDNAKNSLYLQMNSLRDEDTAVYYCAGTVTTYYYFGMDVWGHGTTVTVSS

SEQ ID NO: 4685 - protein, 244 aa, Artificial Sequence
  Synthetic Polypeptide
DIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKGGGGSGGGGSGGGGSEVQLVESGGGSVQPGESLRLSCVASGFTFSRYKMNWVRQAPGKGLEWVSYISRSGRDIYYADSVKGRFTISRDNAKNSLYLQMNSLRDEDTAVYYCAGTVTTYYYDFGMDVWGQGTTVTVSS

SEQ ID NO: 4686 - protein, 243 aa, Artificial Sequence
  Synthetic Polypeptide
QSVLTQPPSASGTPGQRVTISCSGSRSNVGGNYVFWYQQVPGATPKLLIYRSNQRPSGVPDRFAGSKSGSSASLAISGLRSEDEADYYCATWDDSLSGFVFGTGTKVTVLGGGGGSGGGGSGGGGSEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARGYGKAYDQWGQGTLVTVSS

SEQ ID NO: 4687 - protein, 242 aa, Artificial Sequence
  Synthetic Polypeptide
QSVVTQPPSMSAAPGQQVTISCSGGNSNIERNYVSWYLQLPGTAPKLVIFDNDRRPSGIPDRFSGSKSGTSATLGITGLQTGDEADYYCGTWDSSLRGWVFGGGTKLTVLGGGGGSGGGGSGGGGSEVQLVESGGGLIQPGGSLRLSCAASGFTFSNYAMNWVRQAPGKGLEWVSTINGRGSSTIYADSVKGRFTISRDNSKNTLYLQMNSLRAEDTATYYCARYISRGLGDSWGQGTLVTV

SEQ ID NO: 4688 - protein, 242 aa, Artificial Sequence
  Synthetic Polypeptide
QSVVTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSYVFGTGTKLTVLGGGGGSGGGGSGGGGSEVQLVETGGNLVQPGASLRLSCAASGFSFSGTAMHWVRQAPGKGLEWVSTISSTGRSTYYRDSVKGRFTISRDNSKNTLYLQMNSLRGEDTAVYYCARVSFDYWGQGTLVTVSS

SEQ ID NO: 4689 - protein, 244 aa, Artificial Sequence
  Synthetic Polypeptide
QSVVTQPASVSGSPGQSITISCTGTSSDVGGYNYVSWYQQHPGKAPKLMIYDVSKRPSGVSNRFSGSKSGNTASLTISGLQAEDEADYYCSSYTSSSTLVFGGGTKLTVLGGGGGSGGGGSGGGGSEVQLVESGGAFVQPGGSLRLSCAASGFTFSSYAMTWVRQAPGKGLEWVSTISGRGRSTFYADSVKGRFTISRDNSKNTLYLQMNSLRAEDTAVYYCARYYHAGAFDLWGQGTLVTVSS

SEQ ID NO: 4690 - protein, 242 aa, Artificial Sequence
  Synthetic Polypeptide
DNIELTQSPAIMSASPGERVTMTCSASSSIRYIYWYQQKPGSSPRLLIYDTSNVAPGVPFRFSGSGSGTSYSLTINRMEAEDAATYYCQEWSGYPYTFGGGTKLDIKRGGGGSGGGGSGGGGSQVKLQESGGGLVKPGGSLKLSCAASGFTFSSYGMSWVRQTPDKRLEWVATISSGGSYTYYPDSVKGRFTISRDNAKNTLYLQMSSLKSEDTAMYYCARGNWEGWYFDVWGQGTTVTVSS

SEQ ID NO: 4691 - protein, 252 aa, Artificial Sequence
  Synthetic Polypeptide
DNFMLTQPHSVSESPGKTVTISCTGSGGSIDNNYVHWYQQRPGSAPTTVMFEDNQRPSGVPDRFSGSIDSSSNSASLVISGLKTEDEGDYYCQSSDGSKVVFGGGTKLTVLGQGGGGSGGGGSGGGGSEVQLVQSGGGSLTLSCAASGVVQPGRFTFSSYGMHWVRQAPGKGLEWVSVISYDGSNKYYADSVKGRFTISRDNSKNTLYLQMNSLRTEDTAVYYCAKTLSAGEWIGGGAFDIWGHGTMVTVSS

SEQ ID NO: 4692 - protein, 242 aa, Artificial Sequence
  Synthetic Polypeptide
DVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQNTPVPPKFGSGTKLEIKGGGGSGGGGSGGGGSQVQLQQSGAELVRPGASVKLSCKASGYTFNDYEMHWVKQTPVHGLKWIGALEPKTGDTAYSQKFKGKATLTADKSSSTAYMELRSLTSEDSAVYYCTSCYYYTYSGQGTLVTVSA

SEQ ID NO: 4693 - protein, 241 aa, Artificial Sequence
  Synthetic Polypeptide
DIQLTQSPSSLSASVGDRVTITCRASQGIRNDLGWYQQKPGKAPKRLIYAASSLQNGVPSRFSGSGSGTEFTLTISSLQPEDFATYYCLQHNTYPAFGQGTKVEIKRGGGGSGGGGSGGGGSQVQLQESGPGLVKPSQTLSLTCTVSGGSISSFNYYWSWIRHHPGKGLEWIGYIYYSGSTYSNPSLKSRVTISVDTSKNQFSLTLSSVTAADTAVYYCARGYNWNYFDYWGQGTLVTVSS

SEQ ID NO: 4694 - protein, 242 aa, Artificial Sequence
  Synthetic Polypeptide
DIVLTQSPASLAVSLGQSVTISCRASESVEYYGTSLMQWYQQKPGQPPKLLIYATSNVESGVPARFSGSGSGTDFSLNIHPVEEDDIAMYFCQQSRKLPSTFGGGTKLEIKGGGGSGGGGSGGGGSDVRLQESGPGQVKPSQTVSLTCSVTGYSITNGNHWWNWIRQVSGSKLEWIGYISSSGSTDSNPSLKSRISITRDTSKNQLFLQLNSVTTEDIATYYCARGYYFDYWGQGTTLTVSS

SEQ ID NO: 4695 - protein, 241 aa, Artificial Sequence
  Synthetic Polypeptide
DQSVLTQPPSVSVAPGKTARIPCEGNYIGSSNVHWYQQKPGQAPVLVIHFDSDRPSGIPDRFSGSNSGNMATLTISRVEAGDEADYYCQVWENHGWVFGGGTKLTVLSGGGGSGGGGSGGGGSEVQLVETGGGLVQPGESLRLSCAASGFTFSDYEMNWVRQAPGKGLEWVSYISSSGSTIYYADSVKGRFTIYRDNAKNSLYLQMNSLRAEDTALYYCARAWGVGPPDYWGQGTLVTVSS

SEQ ID NO: 4696 - protein, 249 aa, Artificial Sequence
  Synthetic Polypeptide
DIQMTQSPSSLSASVGDTVTITCQANGYLNWYQQRRGKAPKLLIYDGSKLERGVPSRFSGRRWGQEYNLTINNLQPEDIATYFCQVYEFVVPGTRLDLKRTVAAPGGGGSGGGGSGGGGSQVQLLQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTQVTVSSASTKGP

SEQ ID NO: 4697 - protein, 255 aa, Artificial Sequence
  Synthetic Polypeptide
QSALTQPPSASGSPGQSITISCTGTSNNFVSWYQQHAGKAPKLVIYDVNKRPSGVPDRFSGSKSGNTASLTVSGLQTDDEAVYYCGSLVGNWDVIFGGGTKLTVLGGGGSGGGGSGGGGSQPQLQESGPTLVEASETLSLTCAVSGDSTAACNSFWGWVRQPPGKGLEWVGSLSHCASYWNRGWTYHNPSLKSRLTLALDTPKNLVFLKLNSVTAADTATYYCARFGGEVLRYTDWPKPAWVDLWGRGTLVTVSS

SEQ ID NO: 4698 - protein, 240 aa, Artificial Sequence
  Synthetic Polypeptide
EIVLTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIKRGGGGSGGGGSGGGGSQVQLVQSGGQMKKPGESMRISCRASGYEFIDCTLNWIRLAPGKRPEWMGWLKPRGGAVNYARPLQGRVTMTRDVYSDTAFLELRSLTVDDTAVYFCTRGKNCDYNWDFEHWGRGTPVIVSS

SEQ ID NO: 4699 - protein, 250 aa, Artificial Sequence
  Synthetic Polypeptide
ELVLTQSPGTLSLSAGERATLSCRASQSVSSGSLAWYQQKPGQAPRLLIYGASTRATGIPDRFSGSGSGTDFTLTIGRLEPEDLAVYYCQQYGTSPYTFGQGTKLEIGGGGSGGGGSGGGGSLEQSGAEVKKPGSSVQVSCKASGGTFSMYGFNWVRQAPGHGLEWMGGIIPIFGTSNYAQKFRGRVTFTADQATSTAYMELTNLRSDDTAVYYCARDFGPDWEDGDSYDGSGRGFFDFWGQGTLVTVSS

SEQ ID NO: 4700 - protein, 246 aa, Artificial Sequence
  Synthetic Polypeptide
DVVMTQSPSSLSASVGDRVTITCQSSLDISHYLNWYQQKPGKAPKLLIYDASNLETGVPSRFSGSGSGTHFTFTISSLQPEDFATYYCQQYDNLPLTFGGGTKLEIKRGGGGSGGGGSGGGGSQVQLVQSGGGVVQPGGSLRVSCAASGVTLSDYGMHWVRQAPGKGLEWVAFIRNDGSDKYYADSVKGRFTISRDNSEKTVSLQMSSLRAEDTAVYYCAKNGESGPLDYWYLDLWGRGTLVTVSS

SEQ ID NO: 4701 - protein, 245 aa, Artificial Sequence
  Synthetic Polypeptide
DIVMTQSQDSMATSVGERVTVNCKASQNVDTNVAWYQQKPGQSPEPLLFSASYRYTGVPDRFSGSGSGTDFTLTISSVQAEDVAEYFCQQYNSYPLTFGQGTKLEIKRGGGGSGGGGSGGGGSEVQVEVSGGGLVQPGGSMRLSCAVSGFTFSNYWMNWVRQSPEKGLEWIAEIRLKSNNFARYYAESVKGRFTISRDNSKNSLYLQMISLRAEDTAIYYCTSYGNYVGHYFDHWGQGTLLTVSS

SEQ ID NO: 4702 - protein, 250 aa, Artificial Sequence
  Synthetic Polypeptide
SYELTQPPSVSGTPGQRVAISCSGSSSNIGTRMVTWYQHVPGTAPKLLIFNNNQRPSGVPDRFSASKSGTSASLAIIGLQSDDEADYYCATWDDNVKSYVFGTGTKVTVLGSRGGGGSGGGGSGGGGSLEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARAPQSWYVGDVWGQGTLVTVSS

SEQ ID NO: 4703 - protein, 247 aa, Artificial Sequence
  Synthetic Polypeptide
QSVLTQPPSLSVAPGKTASITCGGNNIGMKSVHWYQQRPGQAPVLVIYYDSDRPSGIPGRFSGSNSGNTATLTISRVEAGDEADYYCQVWDTTGDHPGYVFGTGTKVTVLGGGGSGGGGSGGGGSQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGVYGYSGSAPYDEWGQGTLVTVSS

SEQ ID NO: 4704 - protein, 252 aa, Artificial Sequence
  Synthetic Polypeptide
EIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPRTFGQGTKVEIKRGGGGSGGGGSGGGGSQVQLVQSGGGVVQPGRSLRLSCAASGFTFSSYGMHWVRQAPGKGLEWVAVISYDGSNKYYADSVKGRFTISRDNSKNTLYLQMNSLRAEDTAVYYCARDFDYGDSYYYYGMDVWGQGTTVTVSS

SEQ ID NO: 4705 - protein, 246 aa, Artificial Sequence
  Synthetic Polypeptide
EIVLTQSPATLSLSPGERATLSCRASQSVGSYLAWYQQKPGAPRLLIYDASHRATGIPARFSGSGSGTDFTLTISSLEPEDFAVYYCQQRSNWPPMYTFGQGTKLEIKRGGGGSGGGGSGGGGSEVQLVQSGAEVSVKVSCKASGGKKPGSTFSSYTISWVRQAPGQGLEWMGGIIPIFGTANYAQKFQGRVTITADKSTSTAYMELSSLRSEDTAVYYCAGDTDSSGYYGAVDYWGQGTLVTVSS

SEQ ID NO: 4706 - protein, 230 aa, Artificial Sequence
  Synthetic Polypeptide
DIQMTQSPSSLSASVGDRVTITCQASQDINNYLNWYQQKPGKAPKLLIYDASNLQTGVPSRFSGSGSGTDFTFTIEDIATYYCQQYTFGPGTKVDIKGGGGSGGGGSGGGGSEVQLLESGGGLVQPGGSLRLSCAASGFTFSWYSMTWVRQAPGKGLEWVSSIVPWGDFTQYADSVKGRFTISRDNSKNTLYLQMNSLRAEDTAVYYCAKGPGWGSFDLWGRGTLVTVSS

SEQ ID NO: 4707 - protein, 240 aa, Artificial Sequence
  Synthetic Polypeptide
DIQMTQSPSSLSASVGDRVTITCTASLSVSSTYLHWYQQKPGSSPKLWIYSTSNLASGVPSRFSGSGSGTSYTLTISSLQPEDFATYYCHQYHRSPLTFGGGTKVEIKRGGGGSGGGGSGGGGSEVQLVESGGGLVQPGGSLRLSCAASGFSLTKYGVHWVRQAPGKGLEWVGVKWAGGSTDYNSALMSRFTISKDNAKNSLYLQMNSLRAEDTAVYYCARDHRDAMDYWGQGTLVTVSS

SEQ ID NO: 4708 - protein, 244 aa, Artificial Sequence
  Synthetic Polypeptide
DIQMTQSPSSLSASVGDRVTITCKASQDVGTAVAWYQQKPGKAPKLLIYSASYRSTGVPSRFSGSGSGTDFTLTISSLQPEDFATYYCQHHYSAPWTFGGGTKVEIKGGGGSGGGGSGGGGSEVQLVESGGGLVQPGGSLRLSCAASGFTFSRNGMSWVRQAPGKGLEWVATVSSGGSYIYYADSVKGRFTISRDNAKNSLYLQMNSLRAEDTAVYYCARQGTTALATRFFDVWGQGTLVTVSS

SEQ ID NO: 4709 - protein, 250 aa, Artificial Sequence
  Synthetic Polypeptide
DIVMTQSPSSLTMSVGQKVTMSCKSSHSLLNSRNQKNYLAWFQQKPGQSPKLLVYFASTRESGVPDRFIGSGSGTDFTLTISNVQAEDLADYFCQQHYTTLPTFGGGTKLEIKGGGGSGGGGSGGGGSQIQLVQSGPDLKKPGETVKISCKASGYTFTNTGMNWVKQAPGKGLKWMGWINTYTGEPTYADDFKGRFTFSLETSASTAYLQINNLKNEDTATYFCTRWGYGSSLYYAMDYWGQGTSVTVSS

SEQ ID NO: 4710 - protein, 240 aa, Artificial Sequence
  Synthetic Polypeptide
DIQMTQSPPSLSASVGGKVTITCKASQDIDRYMAWYQDKPGKGPKLLIHDTSTLQPGIPSRFSGSGSGRDYSFSISNLEPEDIATYYCLQYDNLWTFGGGTKLEIKRGGGGSGGGGSGGGGSQVQLVQSGAELVKPGASVKMSCKASGYIFTNYNIHWVKKSPGQGLEWIGAIYPGNGDAPYSQKFQDRATLTADTSSSTTYMELSSLTSEDSAVYYCVRANWDVAFAYWGQGTLVSVSS

SEQ ID NO: 4711 - protein, 241 aa, Artificial Sequence
  Synthetic Polypeptide
DIQMTQSPASLSASVGETVTITCRVSGNIHNYLAWYQQKQGKSPQLLVYNAKTLADGVPSRFSGSGSGTQYSLKINSLQPEDFGSYYCQHFWSNPYTFGGGTKLEIKGGGGSGGGGSGGGGSQVQLQQSGASVKVSCKASELVRPGTGYAFTNYLIEWVKQRPGQGLEWIGVINPGSGGTNYNEKFKGKATLTADKSSSTAYMQLSSLTSDDSAVYFCARYRSYDWYFDVWGAGTTVTVSS

SEQ ID NO: 4712 - protein, 245 aa, Artificial Sequence
  Synthetic Polypeptide
DIQMTQSPSSLSASVGDRVTITCRSSQRIVHSNGNTYLEWYQQTPGKAPKLLIYKVSNRFSGVPSRFSGSGSGTDYTPTISSLQPEDIATYYCFQGSHVPPTFGQGTKLQITGGGGSGGGGSGGGGSEVQLVESGGGVVQPGRSLRLSCSSSGPTFSDYYMYWVRQAPGKGLEWVAYMSNVGAITDYPDTVKGRPTISRDNSKNTLFLMDSLRPEDTGVYFCARGTRDGSWFAYWGQGTPVTVSS

SEQ ID NO: 4713 - protein, 240 aa, Artificial Sequence
  Synthetic Polypeptide
DIQMTQSFSSLSASVGDRVTITCRASQDISNYLNWYQQKPGKAPKLLIYYTSRLHSGVPSRFSGSGSGTDYTLTISSLQPEDFATYFCQQGNTLPWTFGGGTKLEIKRGGGGSGGGGSGGGGSEVQLVQSGGGLVQSGGSLRLSCRASGYTFTRYWMLWVRQRPGKGLEWVAEINPRNDRTNYNEKFKTRFTISVDRSKNTLYLQMDSLRAEDTAVYFCALGGGYAMDYWGQGTLVTVSS

SEQ ID NO: 4714 - protein, 241 aa, Artificial Sequence
  Synthetic Polypeptide
DIQMTQSPASLSASVGETVTIICRASVNIYSYLAWYQQKQGKSPQLLVYNAKILAEGVPSRFSGSGSGTQFSLKINSLQPEDFGSYYCQHHYGTFTFGSGTKLEIKRGGGGSGGGGSGGGGSQVQLKESGPGLVAPSQSLSITCTISGFSLTSYGVHWVRQPPGKGLEWLVVIWSDGSTTYNSALKSRLSISKDNSKSQVFLKMNSLQTDDTAIYYCASHYGSTLAFASWGHGTLVTVSAA

SEQ ID NO: 4715 - protein, 249 aa, Artificial Sequence
  Synthetic Polypeptide
DIVMTQSHKFMSTSVGDRVSVTCKASQNVGNNVAWYQQKPGQSPKVLIYSASYRYSGVPDRFTGSGSGTDFTLTISNVQSEDLAEYFCQQYNTYPFTFGSGTKLEIKGGGGSGGGGSGGGGSEVQLEESGGGLVQPGGSMKLSCVASGFTFSNYWMNWVRQSPEKGLEWVAEIRFKSHNYATHFAESVKGRFTISRDDSKSSVYLQMNNLRAEDTGIYYCTRRIGNSDYDWWYFDVWGAGTSVTVSSAS

SEQ ID NO: 4716 - protein, 244 aa, Artificial Sequence
  Synthetic Polypeptide
DIQLTQSPSSLSASVGDRVTITCKASQSVDYEGDSFLNWYQQKPGKAPKLLIYAASNLESGVPSRFSGSGSGTDFTLTISSLQPEDFATYYCQQSNEDPLTFGQGTKVEIKRGGGGSGGGGSGGGGSEVQLVESGGGLVQPGGSLRLSCAASGYTFSSYWIEWVRQAPGKGLEWIGEILPGGGDTNYNEIFKGRATFSADTSKNTAYLQMNSLRAEDTAVYYCTRRVPIRLDYWGQGTLVTVSS

SEQ ID NO: 4717 - protein, 251 aa, Artificial Sequence
  Synthetic Polypeptide
DQSVLTQPPSVSGAPGQRVTISCTGSSSNIGAGYDVHWYQQLPGTAPKLLIYGNSNRPSGVPDRFSGSKSGTSASLAITGLQAEDEADYYCQSYDNSLSSWVFGGGTKLTVLGQPKGGGGSGGGGSGGGGSEVQLQQSGAEVKKPGSSVKVSCKASGGTFSSYAISWVRQAPGQGLEWMGRIIPILGIANYAQKFQGRVTITADKSTSTAYMELSSLRSEDTAVYYCARDVGSGSYSLDYWGQGTLVTVSS

SEQ ID NO: 4718 - protein, 248 aa, Artificial Sequence
  Synthetic Polypeptide
DQSVVTQPPSVSAAPGRKVTISCSGSSSNIGSNYVSWYQQVPGTAPKLLIYEDDKRPSGIPDRFSGSKSGTSATLGITGLQTGDEADYFCATWDRTVNVVRFGGGTRLTVHSQPKGGGGSGGGGSGGGGSQLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARHVGHELDYWGQGTLVTVSS

SEQ ID NO: 4719 - protein, 242 aa, Artificial Sequence
  Synthetic Polypeptide
DIQMTQSPSSLSASVGDRVTITCRASQSISSYLNWYQQKPGKAPKLLIYAASSLQSGVPSGFSGSGSGTDFTLTISSLQPEDFATYYCQQSYSTPLTFGGGTKVEIKRGGGGSGGGGSGGGGSQVQLQESGPGLVKPSETLSLTCTVSGGSVSSGSYYWSWIRQPPGKGLEWIGYIYYSGSTNYNPSLKSRVTISVDTSKNQFSLKLSSVTAADTAVYYCAREGKNGAFDIWGQGTMVTVSS

SEQ ID NO: 4720 - protein, 242 aa, Artificial Sequence
  Synthetic Polypeptide
DQIVLTQSPAIMSASPGEKVTISCSASSSVSYMYWYQQKPGSSPKPWIYRTSNLASGVPARFSGSGSGTSYSLTISNMEAEDAAAYYCQQYHSYPTTFGGGTKLEVKGGGGSGGGGSGGGGSEVQLVESGGGLVQPKGSLKLSCAASGFSFNTYAMNWVRQAPGKGLEWIAHIRSKSNNFATYYADSVKDRFSISRDASENILFLQMNNLKTEDTAMYYCVRQGGDFPMDYWGQGTSVTVSS

SEQ ID NO: 4721 - protein, 240 aa, Artificial Sequence
  Synthetic Polypeptide
DIQMTQSSSSFSVSLGDRVTITCMASEDIYIRLAWYQQKPGNAPRLLISAATSLETGVPSRFSGSGSGKDYTLSITSLQTEDVGTYYCQQYWSSPWTFGGGTKLEINGGGGSGGGGSGGGGSDVQLQESGPGLVKPSQSLSLTCTVTGYSITSDYTWNWIRQFPGNKLEWMGYITYSGSTSYNPSLKSRNSITRDTSKNQFFLQLNSVTTEDTATYYCARLGRRYTMDYWGQGTSVTVSS

SEQ ID NO: 4722 - protein, 240 aa, Artificial Sequence
  Synthetic Polypeptide
DVQLQESGPGLVKPSQSLSLTCTVTGYSITSDYTWNWIRQFPGNKLEWMGYITYSGSTSYNPSLKSRNSITRDTSKNQFFLQLNSVTTEDTATYYCARLGRRYTMDYWGQGTSVTVSSGGGGSGGGGSGGGGSDIQMTQSSSSFSVSLGDRVTITCMASEDIYIRLAWYQQKPGNAPRLLISAATSLETGVPSRFSGSGSGKDYTLSITSLQTEDVGTYYCQQYWSSPWTFGGGTKLEIN

SEQ ID NO: 4723 - protein, 241 aa, Artificial Sequence
  Synthetic Polypeptide
DIQMTQSSSSFSVSLGDRVTITCKASEDIYIRLAWYQQKPGNAPRLLISAATSLETGIPSRFSGSGSGEDYTLTITSLQTEDVATYYCQQYWTTPWTFGGGTKLEIKRGGGGSGGGGSGGGGSDVQLQESGPGLVKPSQSLSLTCTVTGYSITIDYTWNWIRQFPGNKLEWMGYITYSGSTDYNPSLKSRSSITRDTSMNQFFLQLNSVTTEDTATYYCARLGRRYALDYWGQGTSVTVSS

SEQ ID NO: 4724 - protein, 242 aa, Artificial Sequence
  Synthetic Polypeptide
DIVMTQAAPSIPVTPGESVSISCRSDKSLLHSNGNTYLFWFLQRPGQSPQLLIYRMSNLASGVPDRFSGSGSGTAFTLRISGVEAEDVGVYYCMQHLEYPYTFGGGTKLEIKGGGGSGGGGSGGGGSQVQLQQSGPELVKPGASVKMSCKASGYAFSSSWLNWVRQRPGKGLEWIGRIYPGDGENHYNGKFKGKATLTADKSSSTGYMQLSSLTSEDSAVYFCASYYEGGYWGQGTLITVSA

SEQ ID NO: 4725 - protein, 241 aa, Artificial Sequence
  Synthetic Polypeptide
DIVLTQSPASLAVSLGQSVTISCRASESVEYYGTSLMQWYQQKPGQPPKLLIYGASNVESGVPARFSGSGSGTDFSLNIHPVEEDDIAMYFCQQSRKVPWTFGGGTKLEIKGGGGSGGGGSGGGGSEVKLVESGGGLVKPGGSRKLSCAASGFTFSSYTMSWVRQTPAKRLEWVATISSGSSTIYYADTVKGRFTISRDNAKNTLFLQMTSLRSEDTAMYYCARRWFLDCWGQGTTLTVSS

SEQ ID NO: 4726 - protein, 244 aa, Artificial Sequence
  Synthetic Polypeptide
DQVQLQQSGPGLVKPSETLSLTCTVSGDSISSYYWSWIRQPPGKGLEWIGYIYYSGSTNYNPSLKSRVTISVDTSKSQFSLKLSSVTAADTAVYYCARGRYFDVWGRGTMVTSSGGGGSGGGGSGGGGSSSYVLTQPPSVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLGAAA

SEQ ID NO: 4727 - protein, 245 aa, Artificial Sequence
  Synthetic Polypeptide
DIVMTQSPLSLPVTPGEPASISCRSSKSLLHSNGNTYLYWFQQKPGQAPRLLIYRMSNLASGVPDRFSGSGSGTAFTLKISRVEAEDVGVYYCMQHIEYPFTFGQGTKLEIKGGGGSGGGGSGGGGSQVQLVQSGPEVKKPGASVKVSCKASGYTFTNSWMNWVRQRPGKGLEWIGRIYPGDGETIYNGKFRVRVTITADESTSTAYMELSSLRSEDTAVYYCARGYDDYSFAYWGQGTTVTVSS

SEQ ID NO: 4728 - protein, 244 aa, Artificial Sequence
  Synthetic Polypeptide
EIVMTQSPATLSLSPGERATLSCRASQSVSSYLAWYQQKPGQAPRLLIYDASNRATGIPARFSGSGSGTDFTLTISSLEPEDFAVYYCHQYGSSPQTFGQGTKVEIKRGGGGSGGGGSGGGGSEVQLVQSGAEVKKPGSSVKVSCKASGGTFSSYAISWVRQAPGQGLEWMGGIIPIFGTANYAQKFQGRVTITADESTSTAYMELSSLRSEDTAVYYCAVHYGDYVFSSMDVWGQGTTVTVSS

SEQ ID NO: 4729 - protein, 247 aa, Artificial Sequence
  Synthetic Polypeptide
ETTLTQSPGTLSLSPGERATLSCRASQSVSSSYLAWYQQKPGQAPRLLIYGASSRATGIPDRFSGSGSGTDFTLTISRLEPEDFAVYYCQQYGSSPRTFGQGTKVEIKRGGGGSGGGGSGGGGSEVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGPEYCINGVCSLDVWGQGTTVTVSS

SEQ ID NO: 4730 - protein, 250 aa, Artificial Sequence
  Synthetic Polypeptide
DIELTQSPSSLAVSAGEKVTMSCKSSQSLLNSRTRKNQLAWYQQKPGQSPELLIYWASTRQSGVPDRFTGSGSGTDFTLTISSVQAEDLAVYYCQQSYNLLTFGPGTKLEVKRGGGGSGGGGSGGGGSVKLQESGGGFVKPGGSLKVSCAASGFTFSSYAMSWVRLSPEMRLEWVATISSAGGYIFYSDSVQGRFTISRDNAKNTLHLQMGSLRSGDTAMYYCARQGFGNYGDYYAMDYWGQGTTVTVSS

SEQ ID NO: 4731 - protein, 249 aa, Artificial Sequence
  Synthetic Polypeptide
DIQMTQSPSSLSASVGDRVTITCRSSQNIVHSNGNTYLDWYQQTPGKAPKLLIYKVSNRFSGVPSRFSGSGSGTDFTFTISSLQPEDIATYYCFQYSHVPWTFGQGTKLQIGGGGSGGGGSGGGGSQVQLQQSGAEVKKPGSSVKVSCKASGYTFTNYYIYWVRQAPGQGLEWIGGINPTSGGSNFNEKFKTRVTITADESSTTAYMELSSLRSEDTAFYFCTRQGLWFDSDGRGFDFWGQGTTVTVSS

SEQ ID NO: 4732 - protein, 239 aa, Artificial Sequence
  Synthetic Polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIKRGGGGSGGGGSGGGGSQVHLQESGPGLVKPSETLSLTCTVSDDSISSYYWSWIRQPPGKGLEWIGHISYSGSANYNPSLKSRVTISVDTSKNQFSLKLSSVTAADTAVYYCANWDDAFNIWGQGTMVTVSS

SEQ ID NO: 4733 - protein, 241 aa, Artificial Sequence
  Synthetic Polypeptide
DVVMTQTPLTLSVTIGQPASISCKSSQSLLDSDGKTYLHWLLQRPGQSPKRLIFLVSKLDSGVPDRFTGSGSGTDFTLKISRVEAEDLGVYYCWQGTHFPQTFGGGTKLEIKGGGGSGGGGSGGGGSVQLQESGPDLVKPSQSLSLTCTVTGYSITSGYSWHWIRQFPGNKLEWMGYIHYSGDTDYNPSLKSRFSITRDTSKNQFFLQLNSVTTEDTATYYCATPGGFVYWGQGTLVTVSS

SEQ ID NO: 4734 - protein, 245 aa, Artificial Sequence
  Synthetic Polypeptide
DQSELTQPRSVSGSPGQSVTISCTGTERDVGGYNYVSWYQQHPGKAPKLIIHDVIERSSGVPDRFSGSKSGNTASLTISGLQAEDEADYYCWSFAGGYYVFGTGTDVTVLGGGGSGGGGSGGGGSFEVQLLESGGGLVQPGGSLRLSCAASGFTFSTYQMSWVRQAPGKGLEWVSGIVSSGGSTAYADSVKGRFTISRDNSKNTLYLQMNSLRAEDTAVYYCAGELLPYYGMDVWGQGTTVTVSS

SEQ ID NO: 4735 - protein, 244 aa, Artificial Sequence
  Synthetic Polypeptide
DQSELTQPRSVSGSPGQSVTISCTGTERDVGGYNYVSWYQQHPGKAPKLIIHDVIERSSGVPDRFSGSKSGNTASLTISGLQAEDEADYYCWSFAGGYYVFGTGTDVTVLGGGGSGGGGSGGGGSEVQLLESGGGLVQPGGSLRLSCAASGFTFSTYEMHWVRQAPGKGLEWVSVILSSGGETNYADSVKGRFTISRDNSKNTLYLQMNSLRAEDTAVYYCAGMLLPYYGMDVWGQGTTVTVSS

SEQ ID NO: 4736 - protein, 241 aa, Artificial Sequence
  Synthetic Polypeptide
DIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRGGGGSGGGGSGGGGSEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSS

SEQ ID NO: 4737 - protein, 242 aa, Artificial Sequence
  Synthetic Polypeptide
AIVMTQTPSPVSAAVGGTVTINCQASESVYSNNYLSWFQQKPGQPPKLLIYLASTLASGVPSRFKGSGSGTQFTLTISGVQCDDAATYYCIGGKSSSTDGNAFGGGTEVVVRGGGGSGGGGSGGGGSQSLEESGGRLVKPDETLTITCTVSGIDLSSNGLTWVRQAPGEGLEWIGTINKDASAYYASWAKGRLTISKPSSTKVDLKITSPTTEDTATYFCGRIAFKTGTSIWGPGTLVTVSS

SEQ ID NO: 4738 - protein, 240 aa, Artificial Sequence
  Synthetic Polypeptide
DIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKGGGGSGGGGSGGGGSQVQLVQSGAEVKKPGASVKVSCKASGYTFTSYDVHWVRQAPGQRLEWMGWLHADTGITKFSQKFQGRVTITRDTSASTAYMELSSLRSEDTAVYYCARERIQLWFDYWGQGTLVTVSS

SEQ ID NO: 4739 - protein, 258 aa, Artificial Sequence
  Synthetic Polypeptide
DIVMTQSPLSLPVTPGEPASISCRSSQSLLHSNGYNYLVWYLQKPGQSPQLLIYLGSIRASGVPDRFSGSGSGTDFTLKISRVEAEDVGVYYCMQPLQTPITFGQGTRLEIKRGGGGSGGGGSGGGGSGLQCVAAPRWVLSQVQLQQWGAGLLKPSETLSLTCAVYGGSFSGNYWSWIRQPPGKGLEWIGEINHSGSTNYNPSLKSRVTISVDTSKNQFSLKLSSVTAADTAVYYCARGGSYNYFDYWGQGTLVTVSS

SEQ ID NO: 4740 - protein, 255 aa, Artificial Sequence
  Synthetic Polypeptide
QLTQSPSSVSASVGDRVTITCRASRGISSWLAWYQQKPGKAPKLLIYTASSLQSGVPSRFSGSGSGTDFTLTISSLQPEDFATYYCQQAYSFPRTFGQGTKVEIKRGGGGSGGGGSGGGGSVAAPRWVLSQVQLQESGPGLVKPSQTLSLTCTVSGGSISSGGYYWIWIRQHPGKGLEWIGYIYYNGNTYYNPSLKSRVTMSVDTSKNQFSLKLSSVTAADTAVYYCARDGITMIRGYYYGMDVWGQGTTVTVSS

SEQ ID NO: 4741 - protein, 230 aa, Artificial Sequence
  Synthetic Polypeptide
DIVVTQSPASLAVSLGQRATISYRASKSVSTSGYSYMHWNQQKPGQPPRLLIYLVSNLESGVPARFSGSGSGTDFTLNIHPVEEEDAATYYCQHIRELTRSEGGPSWKGGGGSGGGGSGGGGSEVKLEESGGDLVKPGGSLKLSCAASGFTFSGYGMSWVRQTPDKRLEWVATISSGGSYTYYPDSVKGRFTISRDNAKNTLYLQMSSLKSEDTAMYYCARHEGGYYGSS

SEQ ID NO: 4742 - protein, 245 aa, Artificial Sequence
  Synthetic Polypeptide
DIQMTQSPSSLSASVGDRVTITCRASQGISNYLAWYQQKTGKVPKFLIYEASTLQSGVPSRFSGGGSGTDFTLTISSLQPEDVATYYCQNYNSAPFTFGPGTKVDIKGGGGSGGGGSGGGGSQVQLVESGGGVVQPGRSLRLSCAASGFAFSRYGMHWVRQAPGKGLEWVAVIWYDGSNKYYADSVKGRFTISRDNSKNTQYLQMNSLRAEDTAVYYCARGGDFLYYYYYGMDVWGQGTTVTVSS

SEQ ID NO: 4743 - protein, 237 aa, Artificial Sequence
  Synthetic Polypeptide
DIQMTQSPSSLSTSVGDRVTLTCKASQDVGTAVDWYQQKPGPSPKLLIYWASTRHTGIPSRFSGSGSGTDFTLTISSLQPEDFADYYCQQYNSYPLTFGPGTKVDIKGGGGSGGGGSGGGGSEVQLVQSGPEVKKPGATVKISCKTSGYTFTEYTIHWVKQAPGKGLEWIGNINPNNGGTTYNQKFEDKATLTVDKSTDTAYMELSSLRSEDTAVYYCAAGWNFDYWGQGTLLTVSS

SEQ ID NO: 4744 - protein, 238 aa, Artificial Sequence
  Synthetic Polypeptide
DIQMTQSPSSLSASVGDRVTITCKASQDIYPYLNWFQQKPGKAPKTLIYRTNRLLDGVPSRFSGSGSGTDFTFTISSLQPYYCLQYDEFPLTFGAGTKLEIKRGGGGSGGGGSGGGGSQITLKESGPTLVKPTQTLTLTCTFSGFSLSTSNMGVGWIRQPPGKALEWLAHIWWDDDKYYSPSLKSRLTITKDTSKNQVVLTMTNMDPVDTATYYCVRSNYGYAWFAYWGQGTLVTVSS

SEQ ID NO: 4745 - protein, 238 aa, Artificial Sequence
  Synthetic Polypeptide
DIVMTQSQKFMSTSVGDRVNVTCKASQNVGTNVVWYQQKTGQSPKALIHSASYRYSGVPDRFTGSGSGTDFTLTLSNVQSEDLAEYFCQHYNSFPYTFGGGTKLEIKRGGGGSGGGGSGGGGSQVQLQQSGAELVRPGVSVKISCKGSGYRFTDYPIHWVKQSHAKSLEWIGIISTYYGDVTNNPKFRGKATMTVDKSSTTAYMELARLTSEDSAIYYCARNDLFAYWGQGTLVTVSA

SEQ ID NO: 4746 - protein, 241 aa, Artificial Sequence
  Synthetic Polypeptide
DIKMTQSPSSMYASLGERVTITCKASPDINSYLSWFQQKPGKSPKTLIYRANRLVDGVPSRFSGGGSGQDYSLTINSLEYEDMGIYYCLQYDEFPYTFGGGTKLEMKGGGGSGGGGSGGGGSEVKLVESGGGLVKPGGSLKLSCAASGFTFSSYAMSWVRQIPEKRLEWVASISRGGTTYYPDSVKGRFTISRDNVRNILYLQMSSLRSEDTAMYYCGRYDYDGYYAMDYWGQGTSVTVSS

SEQ ID NO: 4747 - protein, 243 aa, Artificial Sequence
  Synthetic Polypeptide
DVVVTPVSCFLSCISGAEGHHLIQGQQKCQYIWLLYALEPTETRTATQTPHLSCIQPRIWGPCQVQWQWVWDRLHPQHPSCGGGGCCNLLLSAHGAYTFGGGTRLELKGGGGSGGGGSGGGGSEVKLQESGPELVKPGASVKMSCKASGYTFTSYVMHWVKQKPGQGLEWIGYINPYNDGTKYNEKFKGKATLTSDKSSSTAYMELSSLTSEDSAVYYCARWKIYYGNYEDYWGQGTPLTVSS

SEQ ID NO: 4748 - protein, 274 aa, Artificial Sequence
  Synthetic Polypeptide
DEFQVQLVQSGGGLVQPGGSLRLSCAASDFDFAAYEMSWVRQAPGQGLEWVAIISHDGIDKYYTDSVKGRFTISRDNSKNTLYLQMNTLRAEDTATYYCLRLGAVGQGTLVTVSSLEGGGGSGGGGSGGGGSGSGGSGSGGSGSGGSGSGGSFEQVQLVQSGGGLVQPGGSLRLSCAASDFAFDDYEMSWVRQAPGKALEWIGDINHSGTTIYNPSLKSRVTISRDNSKNTLYLQMNTLRAEDTAIYYCARPHYGDYSDAFDIWGQGTMVTVSS

SEQ ID NO: 4749 - protein, 249 aa, Artificial Sequence
  Synthetic Polypeptide
EIVMTQSPATLSVSPGERATLSCRASQSVSSNLAWYQQKPGQAPRLLIYGASTRATGIPARFSGSGSGTDFTLTISSLQSVDSAVYYCQQYNNWPPYTFGQGTKLEIKGGGGSGGGGSGGGGSQVQLLESGGGVVQPGRSLRLSCAASGFTFSFYGMHWVRQAPGKGLEWVAAISYDGSNKYYADSVKGRFTISRDNSKNTLYLQMNSLRAEDTAVYYCAKRPNQFYCSDGRCYSIDYWGQGTLVTVSS

SEQ ID NO: 4750 - protein, 245 aa, Artificial Sequence
  Synthetic Polypeptide
QSVLTQPPSASAGGTPGQRVTISCSGSSSNIGSNFVYWYQQLPGTAPKLLIYRNNQRPSGVPDRFSGSRSGTSASLAGLRSEDEADYYCAADSLGGHYVFGTGTKVLGGGGSGGGGSGGGGSQVQLVESGGGSVQPGRSLRLSCEASGFTFEAYAMHWVRQPPGKGLEWVSSINWNSGRIAYADSVKGRFTISRDNARNSLYLQMNSLRLEDTAFYYCAKDIRRFSTGGAEFEYWGQGTLVTVSS

SEQ ID NO: 4751 - protein, 240 aa, Artificial Sequence
  Synthetic Polypeptide
ENVLTQSPAIMSASPGEKVTMTCSASSSVSYMHWYQQKSSTSPKLWIYDTSKLASGVPGRFSGSGSGNSYSLTISSMEAEDVATYYCFQGSGYPLTFGAGTKLELKGGGGSGGGGSGGGGSQVQLKESGPGLVAPSQSLSITCTVSGFSLSSQGVYWVRQPPGKGLEWLGAIWAGGSTNYNSALMSRLSISKDNSKSQVFLKMNSLQTDDTAMYYCARVDGYRGYNMDYWGQGTSVTVSS

SEQ ID NO: 4752 - protein, 243 aa, Artificial Sequence
  Synthetic Polypeptide
DIQMTQSPSSLSASVGDRVTITCRASQSISSYLNWYQQKPGKAPKLLIYDASNLETGVPSRFSGSGSGTDFTFTISSLQPEDIATYYCQQYDNLPLTFGGGTKVDIKRGGGGSGGGGSGGGGSQVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARAHNSSSWSFDYWGQGTLVTVSS

SEQ ID NO: 4753 - protein, 252 aa, Artificial Sequence
  Synthetic Polypeptide
DVVMTQSPLSLPVSLGDQASISCRSSQRLVHSNGNTYLHWYLQKPGQSPKLLIYRVSNRFPGVPDRFSGSGSGTDFTLKISRVEAEDLGIYFCSQSTHVPYTFGGGTKLEIKRGGGGSGGGGSGGGGSEVRLQQSGPDLIKPGASVKMSCKASGYTFTGYVMHWVKQRPGQGLEWIGFINPYNDDIQSNERFRGKATLTSDKSSTTAYMELSSLTSEDSAVYYCARGAGYNFDGAYRFFDFWGQGTTLTVSS

SEQ ID NO: 4754 - protein, 243 aa, Artificial Sequence
  Synthetic Polypeptide
SYELTQPPSVSVSPGQTATISCSGDQLGGKYGHWYQKKPGQSPVLVLYQDRKRPAGIPERFSGSSSGNTITLTISGTQAVDEADYYCQAWDTNLGGVFGGGTKVTVLGQGGGGSGGGGSGGGGSQVQLVESGAEVKKPGASVKVSCKASGYTFTGYYMHWVRQAPGQGLEWMGRINPNSGGTNYAQKFQGRVTMTRDTSISTAYMELSRLRSDDTAVYYCASPRGRGSAFDIWGQGTLVTVSS

SEQ ID NO: 4755 - protein, 246 aa, Artificial Sequence
  Synthetic Polypeptide
NFMLTQPHSVSESPGKTVTISCTRSSGSIASKYVQWYQQRPGSSPTTVIYEDNQRPSGVPDRFSGSIDTSSNSASLTISGLRTEDEADYYCHSYDSNNHSVFGGGTKVTVLGQGGGGSGGGGSGGGGSEVQLVESGGGVVQPGGSLRLSCAASGFTFSSYAMSWVRQAPGKGLEWVSAISGSGGSTYYADSVKGRFSISRDNSKNTLYLQMNSLRAEDTAVYYCARTRSSGAFDIWGQGTLVTVSS

SEQ ID NO: 4756 - protein, 242 aa, Artificial Sequence
  Synthetic Polypeptide
DIQMNQSPSSLSASLGDTITITCHASQNINVWLSWYQQKPGNIPKLLIYKASNLHTGVPSRFSGSGSGTGFTITISSLQPEDIATYYCQQGQSYPWTFGGGTKLEIKRGGGGSGGGGSGGGGSEVQLQQSGPELVKPGASVKISCKASGYSFTGYFMNWVKQSHGKSLEYIGRFNPYNGETLYNQKFKGKATLTVDKSSSTVHMELLSVTSEDSAVYYCGRSGNDDAMDYWGQGTSVTVSSA

SEQ ID NO: 4757 - protein, 242 aa, Artificial Sequence
  Synthetic Polypeptide
DIQMTQSPSILSASVGDRVTITCRASQRFGDYLAWYQQKPGQAPKLLIYGASTLQSGVPSRFSGSGSGTEFTLTISGLQPEDFATYYCQQANSFPITFGKGTRLDIRRGGGGSGGGGSGGGGSQVQLVQSGAEVKKPGSSVKVSCKASGGTFSSYAISWVRQAPGQGLEWMGWINVGNGNAIYSQKFQGRVTITRDTSATTAYMELSSLRSEDTAVYYCARDGERAWDLDYWGQGTLVTVSS

SEQ ID NO: 4758 - protein, 247 aa, Artificial Sequence
  Synthetic Polypeptide
ETTLTQSPGTLSLSPGERATLSCRASQSVSSSYLAWYQQKPGQAPRLLIYGASSRATGIPDRFSGSGSGTDFTLTISRLEPEDFAVYYCQQYGSSPYTFGQGTKLEIKRGGGGSGGGGSGGGGSQVQLVQSGGGVVQPGRSLRLSCAASGFTFSSYAMHWVRQAPGKGLEWVAVISYDGSNKYYADSVKGRFTISRDNSKNTLYLQMNSLRAEDTAVYYCARELRFLEWSSDAFDIWGQGTMVTVSS

SEQ ID NO: 4759 - protein, 240 aa, Artificial Sequence
  Synthetic Polypeptide
DIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKGGGGSGGGGSGGGGSQVQLVQSGAEVRKPGSSVKVSCKASGGSFNNYPIFWVRQAPGQGFEWMGRIIPILGITAYAQKFQGRVTITADKSTSTAYMELNSLRSEDTAVYYCAGGDDLDAFDIWGQGTMVSVSS

SEQ ID NO: 4760 - protein, 243 aa, Artificial Sequence
  Synthetic Polypeptide
EIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKGGGGSGGGGSGGGGSQLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPTMIRGVIDSWGQGTLVTVSS

SEQ ID NO: 4761 - protein, 252 aa, Artificial Sequence
  Synthetic Polypeptide
DIVMTQTPLSLPVTPGEPASISCRSSRSLLDSDDGNTYLDWYLQKPGQSPQLLIYTLSYRASGVPDRFSGSGSGTDFTLKISRVEAEDVGVYYCMQRVEFPITFGQGTRLEIKRGGGGSGGGGSGGGGSQVQLVESGGGVVQPGRSLRLSCAASGFIFSRYGMHWVRQAPGKGLKWVAVIWYDGSNKLYADSVKGRFTISRDNSKNTLYLQMNSLRAEDTAVYYCARDYYDNSRHHWGFDYWGQGTLVTVSS

SEQ ID NO: 4762 - protein, 242 aa, Artificial Sequence
  Synthetic Polypeptide
EIQMTQSPSSMSASLGDTITITCQATQDIFKNLNWYQQKPGKPPSLLIYYATELAEGVPSRFSGSGSGSDYSLTISNLESEDFAAYYCLQFFEFPFTFGSGTKLEMKGGGGSGGGGSGGGGSQVQLQQSGAELVRPGTSVKVSCKASGYVFTNYWIEWIKQRPGQGLEWIGVMNPGSGETTYNEKFKGKATLTADKSSSTAYMQLSSLTSVDSAVYFCARDHDRDYYAMDYWGQGTSVTVSS

SEQ ID NO: 4763 - protein, 239 aa, Artificial Sequence
  Synthetic Polypeptide
DILLTQSPAILSVSPGERVSFSCRASQNIGTSIHWYQQRTNGSPRLLIKYASESVSGIPSRFSGSGSGTDFTLSINSVESEDIADYYCQHTNSWPTTFGGGTKLEIKRGGGGSGGGGSGGGGSQVQLQQSDAELVKPGASVKISCKASGYTFTDHAIHWVKQKPEQGLEWIGYFSPGNGDIKYNEKFKGKATLTADKSSSTAYMQLNSLTSEDSAVYFCKRSYGNYDYWGQGTTLTVSS

SEQ ID NO: 4764 - protein, 244 aa, Artificial Sequence
  Synthetic Polypeptide
DIVMTQSPDSLAVSLGERATINCKSSQSLLNSGDQKNYLTWYQQKPGQPPKLLIYWASTRESGVPDRFSGSGSGTDFTLTISSLQAEDVAVYYCQNDYSYPLTFGQGTKVEIKGGGGSGGGGSGGGGSQVQLVQSGAEVKKTGSSVKVSCKASGYTFTDHAIHVWRQAPGQALEWMGHFSPGNTDIKYNDKFKGRVTLTVDRSMSTAYMELSSLRSEDTAMYYCKTSTFFFDYWGQGTMVTVSS

SEQ ID NO: 4765 - protein, 243 aa, Artificial Sequence
  Synthetic Polypeptide
DIQMTQSPSSLSASVGDRVTITCKASQDVSIAVAWYQQKPGKAPKVLIYSASYRYTGVPDRFSGSGSGTDFTFTISSLQPEDIAVYYCQQHYITPLTFGGGTKVEIKGGGGSGGGGSGGGGSQIQLVQSGHEVKKPGASVKVSCKASGYTFTNYGMNWVRQAPGQGLEWMGWINTKTGEPTYAEEFKGRFVFSLETSASTAYLQISSLKAEDTAMYFCGRGGYGSSYWYFDVWGQGTTVTVSS

SEQ ID NO: 4766 - protein, 245 aa, Artificial Sequence
  Synthetic Polypeptide
DIVMTQSPDSLAVSLGERATINCRASKSVSTSGYSYMHWYQQKPGQPPKLLIYLASNLESGVPDRFSGSGSGTDFTLTISSLQAEDVAVYYCQHSRELPYTFGQGTKLEIKGGGGSGGGGSGGGGSQVQLQESGPGLVKPSETLSLTCTVSGGSISSYGVHWIRQPPGKGLEWIGVIWTSGVTDYNSALMGRVTISVDTSKNQFSLKLSSVTAADTAVYYCARDGDYDRYTMDYWGQGTLVTVSS

SEQ ID NO: 4767 - protein, 241 aa, Artificial Sequence
  Synthetic Polypeptide
QSVLTQPPSVSVSPGQTASITCSGDKLGDKYACWYQQKPGQSPVLVIYQDSKRPSGIPERFSGSNSGNTATLTISGTQAMDEADYYCQAWDSSTAVVFGGGTKLTVLGGGGSGGGGSGGGGSQVQLVQSGAEVKKPGQSLKISCKASGYSLTDNWIGWVRQKPGKGLEWMGIIYPGDSDTRYSPSFQGQVTISADKSINTAYLQWSSLKASDTAIYYCVGLDWNYNPLRYWGPGTLVTVSS

SEQ ID NO: 4768 - protein, 239 aa, Artificial Sequence
  Synthetic Polypeptide
DIVMTQSQKFMSTSVGDRVSIICKASQNVGTFVAWYQQKPGQSPKLLVYSASNRYTGVPDRFTGSGSGTDFTLTINNMQSEDLADYFCRQYSSYPYTFGGGTKLEIKGGGGSGGGGSGGGGSEVQLQQSGPELVKPGASMKISCKASGYSFSAYTMNWVKQSHGKNLEWIGLINPYNGGTNYNQEFEGKATLTVNKSSNTAFMELLSLTSDDSAVYYCARRDWDYFDYWGQGTTLTVSS

SEQ ID NO: 4769 - protein, 250 aa, Artificial Sequence
  Synthetic Polypeptide
AIQMTQSPSSLSASVGDRVTITCRASQSISNYLNWYQQKPGKAPKLLIYAASSLQSGVPSRFSGSGSGTDFTLTISSLQPEDFATYYCQQSYSSPSTTFGQGTKLEIKRGGGGSGGGGSGGGGSEVQLVESGGGLIQPGGSLRLSCAASGFTVSSNYMSWVRQAPGKGLEWVSVTYSGGSTSYADSVKGRFTISRDNSKNTLYLQMNSLRAEDTAVYYCARGGRYCSSISCYARSGCDYWGQGTLVTVSS

SEQ ID NO: 4770 - protein, 245 aa, Artificial Sequence
  Synthetic Polypeptide
DIQMTQSPSSLSASVGDRVTITCRASQSIGTSLHWYQQKPGKAPKLLIKFASRLQSGVPSRFSGSGSGTDFTLTISSLQPEDFATYYCQQSPGFPPTFGQGTKLEIKRGGGGSGGGGSGGGGSQVQLVESGGGLVKPGGSLRLSCAASGFSITTSGYYWTWIRQFPGKGLEWMGYIGYNSKTYYNPALKSRITISRDNAKNSLYLQMNSLRAEDTAVYYCARSLYGGYKDAFDSWGQGTLVTVSS

SEQ ID NO: 4771 - protein, 249 aa, Artificial Sequence
  Synthetic Polypeptide
EIVLTQSPLSLPVTPGEPASISCRSSQSLLHSIGYNYLDWYLQKPGQSPQLLIYLGSNRASGVPDRFSGSGSGTDFTLKISRVEAEDVGVYYCMQALQTPLTFGGGTKVEIKRGGGGSGGGGSGGGGSEVQLVESGGGVVQPGRSLRLSCAASGFTFRSYGMHWVRQAPGKGLEWVAVISYDGSNKYYTDSVNGRFTISRDNSKNTLYLQMNSLRAEDTAVYYCARGGGYYETSGPDYWGQGTLVTVSS

SEQ ID NO: 4772 - protein, 247 aa, Artificial Sequence
  Synthetic Polypeptide
DVVMTQSPLSLPVTPGEPASISCRSSQSLLHSIGYNYLHWFLQKPGQSPQLLIYLGSNRASGVPDRFSGSGSGTDFTLKISRVEAEDVGVYYCMQALQTPPTFGQGTRLEIKRGGGGSGGGGSGGGGSQLQLQESGPGLVKPSGTLSLTCAVSGGSISSSNWWSWVRQPPGKGLEWIGEIYHSGSTNYNPSLKSRVTISVDKSKNQFSLKLSSVTAADTAVYYCVGSPYGDYVLDYWGQGTLVTVSS

SEQ ID NO: 4773 - protein, 251 aa, Artificial Sequence
  Synthetic Polypeptide
DVVMTQSPLSLPVTPGEPASISCRSSQSLLHSNGHNYLDWYLQKPGQSPQLLIYLGSNRASGVPDRFSGSGSGTDFTLKISRVEAEDVGVYYCMQTLQTPLTFGPGTKVDIKRGGGGSGGGGSGGGGSEVQLVETGGGVVQPGRSLRLSCAASGFTFSSYGMHWVRQAPGKGLEWVAVISYDGSNKYYADSVKGRFTISRDNSKNTLYLQMNSLRAEDTAVYYCAKDRYGWGSSFGHFDYWGQGTLVTVSS

SEQ ID NO: 4774 - protein, 245 aa, Artificial Sequence
  Synthetic Polypeptide
EIVLTQSPGTLSLSLGERATLSCRASQSISSSFLAWYQQKPGQAPKLLIYAASTRATGIPDRFSGSGSGTDFTLTISRLEPEDFAVYYCQQYGRSLSFGGGTKVEVKGGGGSGGGGSGGGGSQVQLQQSGPGLVKPSQTLSLTCAISGDSVSGNSATWNWIRQSPSRGLEWLGRTYYRSKWNHDYAESVKSRITINPDTSKNQFSLQLNSVTPEDTAVYYCARGDSSSWYAFDYWGQGTLVTVSS

SEQ ID NO: 4775 - protein, 245 aa, Artificial Sequence
  Synthetic Polypeptide
QTVVTQPPSASGTPGQRVTISCSGSSSNIGSNYVYWYQQLPGTAPKLLIYRSNQRPSGVPDRFSGSKSGTSASLAISGPRSVDEADYYCAAWDDSLNGVVFGGGTKLTVLGGGGGSGGGGSGGGGSQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARRIPPYYGMDVWGQGTTVTVSS

SEQ ID NO: 4776 - protein, 245 aa, Artificial Sequence
  Synthetic Polypeptide
QSVVTQPPSVSVAPGKTARITCGRNNIGSKSVHWYQQKPGQAPVLVVYDDSDRPSGIPERFSGSNSGNTATLTISRVEAGDEADYYCQVWDSSSDHVVFGGGTKLTVLGGGGGSGGGGSGGGGSEVQLVQSGGGVVRPGGSLRLSCAASGFTFDDYGMSWVRQAPGKGLEWVSGINWNGGSTGYADSVRGRFTISRDNAKNSLYLQMNSLRAEDTALYYCARERGYGYHDPHDYWGQGTLVTVSS

SEQ ID NO: 4777 - protein, 246 aa, Artificial Sequence
  Synthetic Polypeptide
QAVVTQPPSASGTPGQRVTISCSGSSSNIGSNTVNWYQQVPGTAPKLLIYSNNQRPSGVPDRFSGSKSGTSASLAISGLQSEDEADYYCAAWDDSLNGWVFGGGTKLTVLGGGGSGGGGSGGGGSQMQLVQSGAEVKEPGESLRISCKGSGYSFTNFWISWVRQMPGKGLEWMGRVDPGYSYSTYSPSFQGHVTISADKSTSTAYLQWNSLKASDTAMYYCARVQYSGYYDWFDPWGQGTLVTVSS

SEQ ID NO: 4778 - protein, 240 aa, Artificial Sequence
  Synthetic Polypeptide
DIQMTQSPSTLSASVGDRVTITCRASQNINKWLAWYQQRPGKAPQLLIYKASSLESGVPSRFSGSGSGTEYTLTISSLQPDDFATYYCQQYNSYATFGQGTKVEIKRGGGGSGGGGSGGGGSQVQLVQSGAEVKKPGESLKISCKGSGYNFSNKWIGWVRQLPGRGLEWIAIIYPGYSDITYSPSFQGRVTISADTSINTAYLHWHSLKASDTAMYYCVRHTALAGFDYWGLGTLVTVSS

SEQ ID NO: 4779 - protein, 242 aa, Artificial Sequence
  Synthetic Polypeptide
EIVLTQSPGTLSLSPGERATLSCRASQSVSNTYLAWYHQRPGQAPRLLIYGASSRATGIPDRFSGSGSGTDFALTISSLEPEDFAVYYCQQYSNSWTFGQGTKVEIKRGGGGSGGGGSGGGGSQVQLVESGGGVVQPGRSLRLSCAASGFTFSSYDMHWVRQAPGKGLEWVAVISYDGTNEYYADSVKGRFTISRDTSKNTLYLQMNSLRAEDTAVYYCARERYFDWSFDYWGQGTLVSVSS

SEQ ID NO: 4780 - protein, 241 aa, Artificial Sequence
  Synthetic Polypeptide
ELTQDPAVSVALGQTVRITCQGDSLRSNYANWYQQKPGQAPVLVIYGQNNRPSGIPDRFSGSSSGNTASLTITGAQAADEADYYCDSRVSTGNHVVFGGGTKLTVLGQGGGGSGGGGSGGGGSEVQLVQSGAEVKKPGASVKVSCKASGYTFTSYAMHWVRQAPGQRLEWMGWINAGNGNTKYSQKFQGRVTITRDTSASTAYMELSSLRSEDTAVYYCARDISYGSFDYWGQGTLVTVSS

SEQ ID NO: 4781 - protein, 243 aa, Artificial Sequence
  Synthetic Polypeptide
DIVLTQTPATLSVTPGDSVSLSCRASQSISNNLHWYQQKSHESPRLLIKNASQSISGIPSKFSGSGSGTDFTLRINSVETEDFGMYFCQQSNSWPYTFGSGTKLEIKGGGGSGGGGSGGGGSQVKLQQSGPELVKPGASVKISCKASGYSFTGYYMHWVKQSHGNILDWIGYIYPYNGVSSYNQKFKGKATLTVDKSSSTAYMELRSLTSEDSAVYYCARERGLYQLRAMDYWGQGTSVTVSS

SEQ ID NO: 4782 - protein, 234 aa, Artificial Sequence
  Synthetic Polypeptide
DIVMTQTPAIMSASPGQKVTITCSASSSVNYMHWYQQKLGSSPKLWIYDTSKLAPGVPARFSGSGSGTSYSLTISSMEAEDAASYFCHQWSSYPYTFGSGTKLEIKGGGGSGGGGSGGGGSEVQLQESGPDLVKPSQSLSLTCTVTGYSITSGYGWHWIRQFPGNKLEWMGYIHYSGSTTYNPSLKSRISISRDTSKNQFFLQLNSVTTEDTATYYCARSLRYWGQGTTLTVSS

SEQ ID NO: 4783 - protein, 237 aa, Artificial Sequence
  Synthetic Polypeptide
DIQMTQSPSSLSASVGDRVTITCSATSSISYMHWYQQKPGKAPKGWIYDTSKLAHGVPSRFSGSGSGTDFTLTISSLQPEDFATYYCHQRRSYPFTFGQGTKVEIKGGGGSGGGGSGGGGSEVQLVQSGAEVKKPGASVKVSCKASGYTFTNFWIHWVRQAPGQGLEWIGEIDPSDSYTNYNQKFKGRVTITRDTSTSTAYLELSSLRSEDTAVYYCAREITTVDYWGQGTLVTVSS

SEQ ID NO: 4784 - protein, 244 aa, Artificial Sequence
  Synthetic Polypeptide
DIQMTQSPSSLSASVGDRVTITCKASQGFNKYVAWYQQKPGKAPKLLIYYTSTLQPGVPSRFSGSGSGRDYTLTISSLQPEDFATYYCLQYGNLLYAFGQGTKVEIKRGGGGSGGGGSGGGGSEVQLVQSGAEVKKPGASVKVSCKASGYTFTSYWIGWVRQAPGQGLEWIGDIYPGGGYTNYNEKFKGRVTITRDTSTSTAYLELSSLRSEDTAVYYCARLDGSSYRGAMDSWGQGTLVTVSS

SEQ ID NO: 4785 - protein, 248 aa, Artificial Sequence
  Synthetic Polypeptide
DIQLTQSPSSLSASVGDRVTITCRASQSVDYDGDSYMNWYQQKPGKAPKLLIYAASYLESGVPSRFSGSGSGTDFTLTISSLQPEDFATYYCQQSHEDPYTFGQGTKVEIKRGGGGSGGGGSGGGGSEVQLVESGGGLVQPGGSLRLSCAVSGYSITSGYSWNWIRQAPGKGLEWVASITYDGSTNYNPSVKGRITISRDDSKNTFYLQMNSLRAEDTAVYYCARGSHYFGHWHFAVWGQGTLVTVSS

SEQ ID NO: 4786 - protein, 240 aa, Artificial Sequence
  Synthetic Polypeptide
DIQMTQSPSSLSASVGDRVTITCRASQDIRYYLNWYQQKPGKAPKLLIYVASSLQSGVPSRFSGSGSGTEFTLTVSSLQPEDFATYYCLQVYSTPRTFGQGTKVEIKGGGGSGGGGSGGGGSEVQLVESGGGLAKPGGSLRLSCAASGFRFTFNNYYMDWVRQAPGQGLEWVSRISSSGDPTWYADSVKGRFTISRENAKNTLFLQMNSLRAEDTAVYYCASLTTGSDSWGQGVLVTVSS

SEQ ID NO: 4787 - protein, 241 aa, Artificial Sequence
  Synthetic Polypeptide
EIVMTQSPATLSVSPGERATLSCRASQSVSRNLAWYQQKPGQAPRLLIYGASTRATGIPARFSGSGSGTEFTLTIGSLQSEDFAVYYCQQYKTWPRTFGQGTNVEIKGGGGSGGGGSGGGGSQVQLQQWGAGLLKPSETLSLTCAVFGGSFSGYYWSWIRQPPGKGLEWIGEINHRGNTNDNPSLKSRVTISVDTSKNQFALKLSSVTAADTAVYYCARERGYTYGNFDHWGQGTLVTVSS

SEQ ID NO: 4788 - protein, 242 aa, Artificial Sequence
  Synthetic Polypeptide
EIVMTPSSATLSVSPGERATLSCRASQSVSRNLAWYQQKPGQAPRLLIYGASTRATGIPARFSGSGSGTEFTLTISSLQSEDFAVYYCHQYSNWMCSFGQGTKLEIKGGGGSGGGGSGGGGSEVQLLESGGGLVQPGGSLRLSCAASGFTFSRYAMNWVRQAPGKGLEWVSGISGSGGRTYYADSVKGRFTISRDNSKNTLYLQMNSLRAEDTAVYYCAKDRDFWSGPFDYWGQGTLVTVSS

SEQ ID NO: 4789 - protein, 247 aa, Artificial Sequence
  Synthetic Polypeptide
DIQMTQSPSSLSASVGDRVTITCKASKNIRSYLAWYQQKPGKAPKLLIYSGSTLHSGVPSRFSGSGSGTDFTLTISSLQPEDFATYYCQQHHEYPLTFGQGTKVEIKRGGGGSGGGGSGGGGSQVQLQESGPGLVKPSETLSLTCTVSGYTITSGYDWSWIRQPPGKGLEWIGYINYGGSTNYKPSLGSRVTISVDTSKNQFSLKLSSVTAADTAVYYCARYNEYKSYIYDWYFDFWGQGTLVTVSS

SEQ ID NO: 4790 - protein, 244 aa, Artificial Sequence
  Synthetic Polypeptide
QVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSELVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELK

SEQ ID NO: 4791 - protein, 253 aa, Artificial Sequence
  Synthetic Polypeptide
DVMLTQTPLSLPVSLGDQASISCRSSQSILHSTGDTYLEWYLQKPGQSPKLLINKVSNRLSGVPDRFSGSGSGTDFTLKISRVEAEDLGVYYCFQGSHVPWTFGGGTKLEIKRADAAPTVSIFPGGGGSGGGGSGGGGSQVKLQQSGPSLVKPGASVKMSCKASGYTFTDFYMKWVKQSHGKSLEWIGDINPNIGDTFYNQKFKGKATLTVDKSSSTAYMQLNSLTSEDSAVYFCSVGYFDVWGAGTTVTVSS

SEQ ID NO: 4792 - protein, 249 aa, Artificial Sequence
  Synthetic Polypeptide
EIVLTQSPATLSLSPGERATLSCRASQSVSIYLAWYQQKPGQAPRLLIYDASNRATGIPARFSGSGSGTDFTLTISSLEPEDFAVYYCQQRSNWPPFTFGPGTKVDIKGGGGSGGGGSGGGGSQVQLVESGGGVVQPGRSLRLSCAASGFTFSSYGMHWVRQAPGKGLEWVAVIWDDGSNKYYVDSVKGRFTISRDNSKNTLYLQMNSLRAEDTAVYYCARDDYYGSGSFNSYYGTDVWGQGTTVTVSS

SEQ ID NO: 4793 - protein, 234 aa, Artificial Sequence
  Synthetic Polypeptide
DIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKGGGGSGGGGSGGGGSEVQLVQSGGGLVHPGGSLRLSCAGSGFTFSTYLMYWVRQAPGKTLEWVSAIGSGGDTYYADSVKGRFTISRDNAKNSLYLQMNSLRAEDMAVYYCARGLGYWGQGTLVTVSS

SEQ ID NO: 4794 - protein, 253 aa, Artificial Sequence
  Synthetic Polypeptide
LPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGGGGSGGGGSGGGGSEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSS

SEQ ID NO: 4795 - protein, 243 aa, Artificial Sequence
  Synthetic Polypeptide
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSVFGTGTKVLVLGGGGSGGGGSGGGGSQVQLVQSGAEVKKPGSSVKVSCKASGGTFSSYTINVWRQAPGQGLEWMGGFIPISGTVNYAQKFQGRVTITADESTSTAYMELSSLRSEDTAVYYCARPLDWTEDIWGQGTLVTVSS

SEQ ID NO: 4796 - protein, 246 aa, Artificial Sequence
  Synthetic Polypeptide
NFMLTQPHSVSESPGKTVTISCTGSSGSIASNYVQWYQQRPGSAPTILIYEDNKRPSGVPDRFSGSIDSSSNSASLTISGLKTGDEADYYCQSYDDINHWVFGGGTKLTVLGGGGGSGGGGSGGGGSEVQLVQSGAEVKKPGASVKVSCKASGYTFTAYYLHWLRQAPGQGLEWMGWMNTNNGATRYAQKFQDRVTMTRDTSINTAYMEMSGLSSDDTAMYYCARGDISQDFADVWGQGTLVTVSS

SEQ ID NO: 4797 - protein, 238 aa, Artificial Sequence
  Synthetic Polypeptide
QIVLTQSPAIMSASPGEKVTITCSASSSVSYMHWFQQKPGTSPKLWIYSTSNLASGVPARFSGSGSGTSYSLTISRMEAEDAATYYCQQRSSYPPTFGGGTKLEIKGGGGSGGGGSGGGGSQVQLQQSGAELMKPGASVKISCKATGYTFSSYWIEWVKQRPGHGLEWIGEILPGSGSTNYNEKFKGKATFTADTSSNTAYMQLSSLTSEDSAVYYCARYDYPWFAYWGQGTLVTVSA

SEQ ID NO: 4798 - protein, 246 aa, Artificial Sequence
  Synthetic Polypeptide
DIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPFTFGSGTKLEIKGGGGSGGGGSGGGGSQVQLQQPGAELVRPGASVKLSCKASGYTFTSYWINWVKQRPGQGLEWIGNIYPSDSYTNYNQKFKDKATLTVDKSSSTAYMQLSSPTSEDSAVYYCTRSWRGNSFDYWGQGTTLTVSS

SEQ ID NO: 4799 - protein, 244 aa, Artificial Sequence
  Synthetic Polypeptide
DTQMTQSPSSVSASVGDRVTITCRTSQDISNYLNWYQQKPGKAPKLLIYNTSRLHSGVPSRFSGSGSGTDFTLTISSLQPEDFATYYCQQSNMFPYTFGQGTKLEIKGGGGSGGGGSGGGGSQVQLVQSGAEVKKPGASVKVSCKASGYTFNGYFMNWVRQAPGQGLERMGRINPNNGDSFYNQKFQGRVTMTRDTSTSTVYMELPSLRSEDTAVYYCAREGYYGGRGYALDYWGQGTLVTVSS

SEQ ID NO: 4800 - protein, 249 aa, Artificial Sequence
  Synthetic Polypeptide
DIVMTQSPSSLAMSVGQKVTMTCKSSQSLLNSSNQKNYLAWYQQKPGQSPKLLVYFASTRESGVPDRFIGSGSGTDFTLTISSVQAEDLADYFCHQHYSTPLTFGAGTKLELKGGGGSGGGGSGGGGSEVQLQQSGPDLVKPGASVKMSCKASGYTFTSYVMHWVKQKPGQGLEWIGYIYPYNDGTKYNEKFKGKATLTSDKSSSTAYMELSSLTSEDSAVYYCAREEYGNYVRYFDVWGAGTTVTVSS

SEQ ID NO: 4801 - protein, 243 aa, Artificial Sequence
  Synthetic Polypeptide
QSVVTQPPSVSAAPGQKVTISCSGSSSNIGNNYVSWYQQLPGTAPKLLIYDNNKRPSGIPDRFSASKSGTSATLGITGLQTRDEADYYCGTWDSSLSAWVFGGGTKLTVLGGGGGSGGGGSGGGGSQVQLVQSGAEVKKPGSSVKVSCKASGDTFSSYYISWVRQAPGQGLEWMGRIIPILGIANYAQKYQGRVTLSADKSTSTSYMELNSLSSEDTAVYYCALDWSYSIDYWGQGTLVTVSS

SEQ ID NO: 4802 - protein, 247 aa, Artificial Sequence
  Synthetic Polypeptide
EVKLVESGGGLVKFGGSLKLSCAASGFTLSSYYMSWVRQSPEKRLELVAVINSNGGSTYYPDTVKGRFTISRDNAKNTLYLQMSSLKSEDTALYYCARPFYYSNSPFAYWGQGTLVTVSAGGGGSGGGGSGGGGSDVLMTQTPLSLPVSLGDQASISCRSSQSIVHRTGNTYLEWYLQKPGQSPKLLIYKVSNRFSGVPDRFSGSGSGTDFTLKISRVGAEDLGVYYCFQGSHVPYTFGGGTKLEIK

SEQ ID NO: 4803 - protein, 246 aa, Artificial Sequence
  Synthetic Polypeptide
ELVMTQSPASLAVSLGQRATISCRASESVDSYGKSFMHWYQLKPGQPPKLLIYRASNLESGVPARFSGSGSRTDFTLTIDPVEADDAATYYCQQNNEDPWTFGGGTKLEIKGGGGSGGGGSGGGGSEVQLEQSGPELVKPGASVKMSCKASGYTFTNYYMKWVKQSHGKSLEWIGDLNPNNGDTFYNQKFKGKATLTVDKSSNTAYMQLNSLTSEDSAVYYCARTGRYEENAMDYWGQGTSVTVSS

SEQ ID NO: 4804 - protein, 240 aa, Artificial Sequence
  Synthetic Polypeptide
DVVMTQSPSSLSASVGDRVTITCMASEDIYIRLAWYQQKPGNAPKLLIYAATSLETGVPSRFSGSGSGTDFTLTISSLQPEDFATYYCQQYWSSPWTFGGGTKVEIKGGGGSGGGGSGGGGSQVQLQESGPGLVKPSQTLSLTCTVSGYSITSDYTWNWIRQPPGNGLEWIGYITYSGSTSYNPSLKSRVLISVDTSKNQVSLKLSSVTAADTAVYYCARLGRRYTMDYWGQGTTVTVSS

SEQ ID NO: 4805 - protein, 247 aa, Artificial Sequence
  Synthetic Polypeptide
DVLMTQTPVSLSVSLGDQASISCRSSQSIVHSTGNTYLEWYLQKPGQSPKLLIYKISNRFSGVPDRFSGSGSGTDFTLKISRVEAEDLGVYYCFQASHAPRTFGGGTKLEIKRGGGGSGGGGSGGGGSEVILVESGGGLVKPGGSLKLSCAASGFTFSSYTMSWVRQTPEKRLEWVATISSGGGNTYYPDSVKGRFTISRDNAKNNLYLQMSSLRSEDTALYYCARYYRYEAWFASWGQGTLVTVSA

SEQ ID NO: 4806 - protein, 245 aa, Artificial Sequence
  Synthetic Polypeptide
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDKGGGYYDFWSGSDYWGQGTLVTVSSGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCNSRDSSGWVFGGGTKLTVL

SEQ ID NO: 4807 - protein, 254 aa, Artificial Sequence
  Synthetic Polypeptide
EVQLQQSGPGLVKPSQTLSLTCAISGDSVLSNSDTWNWIRQSPSRGLEWLGRTYHRSTWYDDYASSVRGRVSINVDTSKNQYSLQLNAVTPEDTGVYYCARDRLQDGNSWSDAFDVWGQGTMVTVSSGGGGSGGGGSGGGGSQSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTLVYVFGTGTKVTVL

SEQ ID NO: 4808 - protein, 252 aa, Artificial Sequence
  Synthetic Polypeptide
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARGDSNYWSYYGMDVWGQGTLVTVSSGGGGSGGGGSGGGGSGGGGSQSVLTQPRSVSGSPGQSVTISCTGTSSDVGGYNYVSWYQQHPGEAPKLIIYDADKRPSGISNRFSSGKSGNTASLTISGLQVEDEADYYCCSYAGGSTWVFGGGTKVTVL

SEQ ID NO: 4809 - protein, 254 aa, Artificial Sequence
  Synthetic Polypeptide
EVQLQQSGPGLVKPSQTLSLTCAISGDSVSSNSAAWNWIRQSPSRGLEWLGRTYYRSKWYSDYAVSVKSRITINPDTSKNQFSLQLNSVTPEDTAVYYCARDPYDFWSGYPDAFDIWGQGTMVTVSSGGGGSGGGGSGGGGSQSALTQPASVSGSPGQSITISCTGTSSDVGGYNYVSWYQQHPGKAPKVIISEVNNRPSGVSHRFSGSKSGNTASLTISGLQAEDEADYFCSSYTSGRTLYVFGTGSKVTVLG

SEQ ID NO: 4810 - protein, 253 aa, Artificial Sequence
  Synthetic Polypeptide
EVQLQQSGPGLVKPSQTLSLTCAISGDSMLSNSDTWNWIRQSPSRGLEWLGRTYHRSTWYDDYASSVRGRVSINVDTSKNQYSLQLNAVTPEDTGVYYCARVRLQDGNSWSDAFDVWGQGTMVTVSSGGGGSGGGGSGGGGSQSALTQPASASGSPGQSVTISCTGTSSDVGGYNYVSWYQQHPGKAPKLMIYDVSNRPSGVSNRFSGSKSGNTASLTISGLQAEDEADYYCSSYTSSSTLYVFGTGTQLTVL

SEQ ID NO: 4811 - protein, 242 aa, Artificial Sequence
  Synthetic Polypeptide
DVVMTQSPSSLSASVGDRVTITCRASQDISKYLNWYQQKPGKAPKLLIYHTSRLHSGVPSRFSGSGSGTDFTLTISSLQPEDFATYYCQQGNTLPYTFGGGTKVEIKGGGGSGGGGSGGGGSQVQLQESGPGLVKPSQTLSLTCTVSGVSLPDYGVSWIRQPPGKGLEWIGVIWGSETTYYNSALKSRVLISVDTSKNQVSLKLSSVTAADTAVYYCARHYYYGGSYAMDYWGQGTTVTVSS

SEQ ID NO: 4812 - protein, 244 aa, Artificial Sequence
  Synthetic Polypeptide
EIVLTQSPATLSLSPGERATLSCSASSSVSYMYWYQQKPGQAPRLLIYRTSNLASGIPARFSGSGSGTDFTLTISSLEPEDFAVYYCQQYHSYPTTFGQGTKVEIKRTVGGGGSGGGGSGGGGSEVQLVESGGGLVQPGGSLRLSCAASGFSFNTYAMNWVRQAPGKGLEWVSHIRSKSNNFATYYADSVKDRFTISRDNAKNSLYLQMNSLRAEDTAVYYCARQGGDFPMDYWGQGTLVTVSS

SEQ ID NO: 4813 - protein, 240 aa, Artificial Sequence
  Synthetic Polypeptide
DVVMTQSPSSLSASVGDRVTITCKASEDIYIRLAWYQQKPGKAPKLLIYAATSLETGVPSRFSGSGSGTDFTLTISSLQPEDFATYYCQQYWTTPWTFGGGTKVEIKGGGGSGGGGSGGGGSQVQLQESGPGLVKPSQTLSLTCTVSGYSITIDYTWNWIRQPPGKGLEWIGYITYSGSTDYNPSLKSRVLISVDTSKNQVSLKLSSVTAADTAVYYCARLGRRYALDYWGQGTTVTVSS

SEQ ID NO: 4814 - protein, 245 aa, Artificial Sequence
  Synthetic Polypeptide
DIQLTQSPSFLSASVGDRVTITCRASQGISTDLNWYQQKPGKAPKLLIYAASNLESGVPSRFSGSGSGTEFTLTISSLQPEDFATYYCQQSYNWPYTFGGGTKVEIKRGGGGSGGGGSGGGGSEVQLVESGGGLVKPGGSLRLSCAASGFTFSNFEMNWVRQAPGKGLEWVSGISSNGRYINYADSVKGRFTISRDNAKNSLYLQMNSLRAEDTAVYYCARVVDFDQDYNGFDYWGQGTLVTVSS

SEQ ID NO: 4815 - protein, 243 aa, Artificial Sequence
  Synthetic Polypeptide
DIQLTQSPSFLSASVGDRVTITCSLSLGISTWRDWFPPRLGRGLEPLTYAASTLQSGVPSRFSGSGSGTEFTLTISSLQPEDFATYYCQQLNSYPLTFGGGTKVEIKRGGGGSGGGGSGGGGSEVQLVESGGGLVKPGGSLRLSCAASGFTFSTYGMSWVRQAPGKGLEWVAYINNGSGYIYYADSVKGRFTISRDNAKNSLYLQMNSLRAEDTAVYYCARGQWWSGGDFDYWGQGTLVTVSS

SEQ ID NO: 4816 - protein, 10 aa, Artificial Sequence
  Synthetic Polypeptide
EQKLISEEDL

SEQ ID NO: 4817 - protein, 8 aa, Artificial Sequence
  Synthetic Polypeptide
DYKDDDDK

SEQ ID NO: 4818 - protein, 8 aa, Artificial Sequence
  Synthetic Polypeptide
DYKDDDDK

SEQ ID NO: 4819 - protein, 9 aa, Artificial Sequence
  Synthetic Polypeptide
SWKDASGWS

SEQ ID NO: 4820 - protein, 9 aa, Artificial Sequence
  Synthetic Polypeptide
SWKDASGWS

SEQ ID NO: 4821 - protein, 14 aa, Artificial Sequence
  Synthetic Polypeptide
GKPIPNPLLGLDST

SEQ ID NO: 4822 - protein, 9 aa, Artificial Sequence
  Synthetic Polypeptide
YPYDVPDYA

SEQ ID NO: 4823 - protein, 9 aa, Artificial Sequence
  Synthetic Polypeptide
HHHHHHGSG

SEQ ID NO: 4824 - protein, 15 aa, Artificial Sequence
  Synthetic Polypeptide
GLNDIFEAQKIEWHE

SEQ ID NO: 4825 - protein, 8 aa, Artificial Sequence
  Synthetic Polypeptide
WSHPQFEK

SEQ ID NO: 4826 - protein, 8 aa, Artificial Sequence
  Synthetic Polypeptide
WSHPQFEK

SEQ ID NO: 4827 - protein, 66 aa, Artificial Sequence
  Synthetic Polypeptide
GGSWSHPQFEKDYKDDDDKGSDYKDDDDKGSDYKDDDDKGSDYKDDDDKAWSHPQFEKHHHHHHHH

SEQ ID NO: 4828 - protein, 30 aa, Artificial Sequence
  Synthetic Polypeptide
DYKDDDDKDYKDDDDKVETDFYDYKDDDDK

SEQ ID NO: 4829 - protein, 52 aa, Artificial Sequence
  Synthetic Polypeptide
YPYDVPDYAWSHPQFEKYPYDVPDYAGYPYDVPDYAGYPYDVPDYHHHHHHH

SEQ ID NO: 4830 - protein, 17 aa, Artificial Sequence
  Synthetic Polypeptide
INIYNAEPANPSEKNSP

SEQ ID NO: 4831 - protein, 26 aa, Artificial Sequence
  Synthetic Polypeptide
YINIYNAEPANPSEKNSPTQYAYGSG

SEQ ID NO: 4832 - protein, 23 aa, Artificial Sequence
  Synthetic Polypeptide
YINIYNAEPANPSEKNSPSTQYA

SEQ ID NO: 4833 - protein, 15 aa, Artificial Sequence
  Synthetic Polypeptide
AEPANPSEKNSPGGS

SEQ ID NO: 4834 - protein, 168 aa, Artificial Sequence
  Synthetic Polypeptide
KPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGD

SEQ ID NO: 4835 - protein, 170 aa, Artificial Sequence
  Synthetic Polypeptide
VFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILA

SEQ ID NO: 4836 - protein, 147 aa, Artificial Sequence
  Synthetic Polypeptide
EAEAERGKLPGKKLPLEVLIELEANARKAGCTRGCLICLSKIKCTAKMKKYIPGRCADYGGDKKTGQAGIVGAIVDIPEISGFKEMEPMEQFIAQVDRCADCTTGCLKGLANVKCSDLLKKWLPGRCATFADKIQSEVDNIKGLAGD

SEQ ID NO: 4837 - protein, 152 aa, Artificial Sequence
  Synthetic Polypeptide
NPTVNNDVNRGKMPGKKLPLEVLIELEANAFKAGCTRGCLICLSKIKCTAKMKQYIPGRCHDYGGDKKTGQAGIVGAIVDIPEISGFKEMEPLEQFIAQVDLCADCTTGCLKGLANVKCSELLKKWLPDRCASFADKIQKEAHNIKGLAGDR

SEQ ID NO: 4838 - protein, 22 aa, Artificial Sequence
  Synthetic Polypeptide
VKQTLNFDLLKLAGDVESNPGP

SEQ ID NO: 4839 - protein, 18 aa, Artificial Sequence
  Synthetic Polypeptide
EGRGSLLTCGDVEENPGP

SEQ ID NO: 4840 - protein, 18 aa, Artificial Sequence
  Synthetic Polypeptide
EGRGSLLTCGDVEENPGP

SEQ ID NO: 4841 - protein, 19 aa, Artificial Sequence
  Synthetic Polypeptide
ATNFSLLKQAGDVEENPGP

SEQ ID NO: 4842 - protein, 19 aa, Artificial Sequence
  Synthetic Polypeptide
ATNFSLLKQAGDVEQNPGP

SEQ ID NO: 4843 - protein, 20 aa, Artificial Sequence
  Synthetic Polypeptide
QCTNYALLKLAGDVESNPGP

SEQ ID NO: 4844 - protein, 4 aa, Artificial Sequence
  Synthetic Polypeptide
SGSG

SEQ ID NO: 4845 - protein, 4 aa, Artificial Sequence
  Synthetic Polypeptide
SGSG

SEQ ID NO: 4846 - protein, 4 aa, Artificial Sequence
  Synthetic Polypeptide
RAKR

SEQ ID NO: 4847 - protein, 4 aa, Artificial Sequence
  Synthetic Polypeptide
RAKR

SEQ ID NO: 4848 - protein, 4 aa, Artificial Sequence
  Synthetic Polypeptide
RAKR

SEQ ID NO: 4849 - protein, 72 aa, Artificial Sequence
  Synthetic Polypeptide
AKPTTTPAPRPPTPAPTIASQPLSLRPEACRPAAGGAVHTRGLDFACDIYIWAPLAGTCGVLLLSLVITLYC

SEQ ID NO: 4850 - protein, 226 aa, Artificial Sequence
  Synthetic Polypeptide
AKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 4851 - protein, 114 aa, Artificial Sequence
  Synthetic Polypeptide
AKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCEL

SEQ ID NO: 4852 - protein, 42 aa, Artificial Sequence
  Synthetic Polypeptide
KRGRKKLLYIFKQPFMRPVQTTQEEDGCSCRFPEEEEGGCEL

SEQ ID NO: 4853 - protein, 112 aa, Artificial Sequence
  Synthetic Polypeptide
RVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 4854 - protein, 112 aa, Artificial Sequence; identical to SEQ ID NO: 4853
  Synthetic Polypeptide

SEQ ID NO: 4855 - protein, 108 aa, Artificial Sequence
  Synthetic Polypeptide
KIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRS

SEQ ID NO: 4856 - protein, 167 aa, Artificial Sequence
  Synthetic Polypeptide
KESSGGPDSPDTEPGSSAGPTQRPSDNSHNEHAPASQGLKAEHLYILIGVSVVFLFCLLLLVLFCLHRQNQIKQGPPRSKDEEQKPQQRPDLAVDVLERTADKATVNGLPEKDRETDTSALAAGSSQEVTYAQLDHWALTQRTARAVSPQSTKPMAESITYAAVARH

SEQ ID NO: 4857 - protein, 150 aa, Artificial Sequence
  Synthetic Polypeptide
FKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNK

SEQ ID NO: 4858 - protein, 150 aa, Artificial Sequence; identical to SEQ ID NO: 4857
  Synthetic Polypeptide

SEQ ID NO: 4859 - protein, 130 aa, Artificial Sequence
  Synthetic Polypeptide
DGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWS

SEQ ID NO: 4860 - protein, 55 aa, Artificial Sequence
  Synthetic Polypeptide
KNRKAKAKPVTRGAGAGGRQRGQNKERPPPVPNPDYEPIRKGQRDLYSGLNQRRI

SEQ ID NO: 4861 - protein, 185 aa, Artificial Sequence
  Synthetic Polypeptide
DGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 4862 - protein, 160 aa, Artificial Sequence
  Synthetic Polypeptide
QSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRN

SEQ ID NO: 4863 - protein, 160 aa, Artificial Sequence; identical to SEQ ID NO: 4862
  Synthetic Polypeptide

SEQ ID NO: 4864 - protein, 130 aa, Artificial Sequence; identical to SEQ ID NO: 4859
  Synthetic Polypeptide

SEQ ID NO: 4865 - protein, 55 aa, Artificial Sequence; identical to SEQ ID NO: 4860
  Synthetic Polypeptide

SEQ ID NO: 4866 - protein, 185 aa, Artificial Sequence; identical to SEQ ID NO: 4861
  Synthetic Polypeptide

SEQ ID NO: 4867 - protein, 30 aa, Artificial Sequence
  Synthetic Polypeptide
QSFGLLDPKLCYLLDGILFIYGVILTALFL

SEQ ID NO: 4868 - protein, 113 aa, Artificial Sequence
  Synthetic Polypeptide
RVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 4869 - protein, 30 aa, Artificial Sequence; identical to SEQ ID NO: 4867
  Synthetic Polypeptide

SEQ ID NO: 4870 - protein, 113 aa, Artificial Sequence; identical to SEQ ID NO: 4868
  Synthetic Polypeptide

SEQ ID NO: 4871 - protein, 143 aa, Artificial Sequence
  Synthetic Polypeptide
QSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 4872 - protein, 173 aa, Artificial Sequence
  Synthetic Polypeptide
GQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKS

SEQ ID NO: 4873 - protein, 159 aa, Artificial Sequence
  Synthetic Polypeptide
GQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRG

SEQ ID NO: 4874 - protein, 159 aa, Artificial Sequence
  Synthetic Polypeptide
GQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 4875 - protein, 171 aa, Artificial Sequence
  Synthetic Polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFL

SEQ ID NO: 4876 - protein, 163 aa, Artificial Sequence
  Synthetic Polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSS

SEQ ID NO: 4877 - protein, 163 aa, Artificial Sequence
  Synthetic Polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 4878 - protein, 199 aa, Artificial Sequence
  Synthetic Polypeptide
MTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 4879 - protein, 132 aa, Artificial Sequence
  Synthetic Polypeptide
MAKPLSQEESTLIERATATINSIPISEDYSVASAALSSDGRIFTGVNVYHFTGGPCAELVVLGTAAAAAAGNLTCIVAIGNENRGILSPCGRCRQVLLDLHPGIKAIVKDSDGQPTAVGIRELLPSGYVWEG

SEQ ID NO: 4880 - protein, 109 aa, Artificial Sequence
  Synthetic Polypeptide
TRGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 4881 - protein, 107 aa, Artificial Sequence
  Synthetic Polypeptide
GVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLG

SEQ ID NO: 4882 - protein, 217 aa, Artificial Sequence
  Synthetic Polypeptide
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLGTRGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 4883 - protein, 419 aa, Artificial Sequence
  Synthetic Polypeptide
MGSSKSKPKDPSQRGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLGTRGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLETSATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTP

SEQ ID NO: 4884 - protein, 14 aa, Artificial Sequence
  Synthetic Polypeptide
MGSSKSKPKDPSQR

SEQ ID NO: 4885 - protein, 188 aa, Kaposi's sarcoma-associated herpesvirus
MATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTP

SEQ ID NO: 4886 - protein, 301 aa, Artificial Sequence
  Synthetic Polypeptide
MTRGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTP

SEQ ID NO: 4887 - protein, 408 aa, Artificial Sequence
  Synthetic Polypeptide
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLGTRGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTP

SEQ ID NO: 4888 - protein, 419 aa, Artificial Sequence; identical to SEQ ID NO: 4883
  Synthetic Polypeptide

SEQ ID NO: 4889 - protein, 576 aa, Artificial Sequence
  Synthetic Polypeptide
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLGTRGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEGIHMAHFPGFGQSLLYGYPVYVFGDCVQADWCPVSGGLCSTRLHRHALLATCPEHQLTWDPIDGRVVSSPLQYLIPRLPSFPTQRTSRTLKVLTPPTTPVSPKVPPAFFQSMRKHTPYRNGCLEPTLGDQLPSLAFPEPGLRPQNIYTTWGKTVVCLYLYQLSPPMTWPLIPHVIFCHPRQLGAFLTKVPLKRLEELLYKMFLHTGAVIVLPEDDLPTTMFQPVRAPCIQTAWCTGLLPYHSILTTPGLIWTFNDGSPMISGPCPKAGQPSLVVQSSLLIFEKFQTKAFHPSYLLSHQLIQYSSFHNLHLLFDEYTNIPVSRSFNKGEADDNGDQPPEPAAQGESSTQKVRPSHTNNPK

SEQ ID NO: 4890 - protein, 583 aa, Artificial Sequence
  Synthetic Polypeptide
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLGTRGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEGIRAYKDDDDKAHFPGFGQSLLYGYPVYVFGDCVQADWCPVSGGLCSTRLHRHALLATCPEHQLTWDPIDGRVVSSPLQYLIPRLPSFPTQRTSRTLKVLTPPTTPVSPKVPPAFFQSMRKHTPYRNGCLEPTLGDQLPSLAFPEPGLRPQNIYTTWGKTVVCLYLYQLSPPMTWPLIPHVIFCHPRQLGAFLTKVPLKRLEELLYKMFLHTGAVIVLPEDDLPTTMFQPVRAPCIQTAWCTGLLPYHSILTTPGLIWTFNDGSPMISGPCPKAGQPSLVVQSSLLIFEKFQTKAFHPSYLLSHQLIQYSSFHNLHLLFDEYTNIPVSRSFNKGEADDNGDQPPEPAAQGESSTQKVRPSHTNNPK

SEQ ID NO: 4891 - protein, 419 aa, Homo sapiens
MNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAKQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 4892 - protein, 419 aa, Artificial Sequence
  Synthetic Polypeptide
MNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 4893 - protein, 419 aa, Artificial Sequence
  Synthetic Polypeptide
MNRHLWKSQLCEMVQPSGGPAAVQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 4894 - protein, 251 aa, Artificial Sequence
  Synthetic Polypeptide
MNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVG

SEQ ID NO: 4895 - protein, 251 aa, Artificial Sequence
  Synthetic Polypeptide
MNRHLWKSQLCEMVQPSGGPAAVQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVG

SEQ ID NO: 4896 - protein, 275 aa, Artificial Sequence
  Synthetic Polypeptide
MNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALV

SEQ ID NO: 4897 - protein, 275 aa, Artificial Sequence
  Synthetic Polypeptide
MNRHLWKSQLCEMVQPSGGPAAVQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALV

SEQ ID NO: 4898 - protein, 387 aa, Artificial Sequence
  Synthetic Polypeptide
MNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAKQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRS

SEQ ID NO: 4899 - protein, 387 aa, Artificial Sequence
  Synthetic Polypeptide
MNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRS

SEQ ID NO: 4900 - protein, 387 aa, Artificial Sequence
  Synthetic Polypeptide
MNRHLWKSQLCEMVQPSGGPAAVQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRS

SEQ ID NO: 4901 - protein, 338 aa, Artificial Sequence
  Synthetic Polypeptide
MNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAKQEVIDKLKEEAEQHKIVMETVPVLKAQADIYKADFQAERQAREKLAEKKELLQEQLEQLQR

SEQ ID NO: 4902 - protein, 338 aa, Artificial Sequence
  Synthetic Polypeptide
MNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQR

SEQ ID NO: 4903 - protein, 338 aa, Artificial Sequence
  Synthetic Polypeptide
MNRHLWKSQLCEMVQPSGGPAAVQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQR

SEQ ID NO: 4904 - protein, 412 aa, Mus musculus
MNKHPWKNQLSETVQPSGGPAEDQDMLGEESSLGKPAMLHLPSEQGTPETLQRCLEENQELRDAIRQSNQMLRERCEELLHFQVSQREEKEFLMCKFQEARKLVERLSLEKLDLRSQREQALKELEQLKKCQQQMAEDKASVKAQVTSLLGELQESQSRLEAATKDRQALEGRIRAVSEQVRQLESEREVLQQQHSVQVDQLRMQNQSVEAALRMERQAASEEKRKLAQLQAAYHQLFQDYDSHIKSSKGMQLEDLRQQLQQAEEALVAKQELIDKLKEEAEQHKIVMETVPVLKAQADIYKADFQAERHAREKLVEKKEYLQEQLEQLQREFNKLKVGCHESARIEDMRKRHVETPQPPLLPAPAHHSFHLALSNQRRSPPEEPPDFCCPKCQYQAPDMDTLQIHVMECIE

SEQ ID NO: 4905 - protein, 412 aa, Artificial Sequence
  Synthetic Polypeptide
MNKHPWKNQLSETVQPSGGPAEDQDMLGEESSLGKPAMLHLPSEQGTPETLQRCLEENQELRDAIRQSNQMLRERCEELLHFQVSQREEKEFLMCKFQEARKLVERLSLEKLDLRSQREQALKELEQLKKCQQQMAEDKASVKAQVTSLLGELQESQSRLEAATKDRQALEGRIRAVSEQVRQLESEREVLQQQHSVQVDQLRMQNQSVEAALRMERQAASEEKRKLAQLQAAYHQLFQDYDSHIKSSKGMQLEDLRQQLQQAEEALVAAQELIDKLKEEAEQHKIVMETVPVLKAQADIYKADFQAERHAREKLVEKKEYLQEQLEQLQREFNKLKVGCHESARIEDMRKRHVETPQPPLLPAPAHHSFHLALSNQRRSPPEEPPDFCCPKCQYQAPDMDTLQIHVMECIE

SEQ ID NO: 4906 - protein, 200 aa, Artificial Sequence
  Synthetic Polypeptide
MNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVD

SEQ ID NO: 4907 - protein, 120 aa, Artificial Sequence
  Synthetic Polypeptide
MNRHLWKSQLCEMVQPSGGPAAVQDVLGEESPLGKPAMLHLPSEQGAPETLQRCLEENQELRDAIRQSNQILRERCEELLHFQASQREEKEFLMCKFQEARKLVERLGLEKLDLKRQKEQ

SEQ ID NO: 4908 - protein, 150 aa, Artificial Sequence
  Synthetic Polypeptide
MNRHLWKSQLCEMVQPSGGPAAVQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLL

SEQ ID NO: 4909 - protein, 127 aa, Artificial Sequence
  Synthetic Polypeptide
MNRHLWKSQLCEMVQPSGGPAAVQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEH

SEQ ID NO: 4910 - protein, 671 aa, Homo sapiens
MQPDMSLNVIKMKSSDFLESAELDSGGFGKVSLCFHRTQGLMIMKTVYKGPNCIEHNEALLEEAKMMNRLRHSRVVKLLGVIIEEGKYSLVMEYMEKGNLMHVLKAEMSTPLSVKGRIIWEIIEGMCYLHGKGVIHKDLKPENILVDNDFHIKIADLGLASFKMWSKLNNEEHNELREVDGTAKKNGGTLYYMAPEHLNDVNAKPTEKSDVYSFAVVLWAIFANKEPYENAICEQQLIMCIKSGNRPDVDDITEYCPREIISLMKLCWEANPEARPTFPGIEEKFRPFYLSQLEESVEEDVKSLKKEYSNENAVVKRMQSLQLDCVAVPSSRSNSATEQPGSLHSSQGLGMGPVEESWFAPSLEHPQEENEPSLQSKLQDEANYHLYGSRMDRQTKQQPRQNVAYNREEERRRRVSHDPFAQQRPYENFQNTEGKGTVYSSAASHGNAVHQPSGLTSQPQVLYQNNGLYSSHGFGTRPLDPGTAGPRVWYRPIPSHMPSLHNIPVPETNYLGNTPTMPFSSLPPTDESIKYTIYNSTGIQIGAYNYMEIGGTSSSLLDSTNTNFKEEPAAKYQAIFDNTTSLTDKHLDPIRENLGKHWKNCARKLGFTQSQIDEIDHDYERDGLKEKVYQMLQKWVMREGIKGATVGKLAQALHQCSRIDLLSSLIYVSQN

SEQ ID NO: 4911 - protein, 393 aa, Artificial Sequence
  Synthetic Polypeptide
MGIEEKFRPFYLSQLEESVEEDVKSLKKEYSNENAVVKRMQSLQLDCVAVPSSRSNSATEQPGSLHSSQGLGMGPVEESWFAPSLEHPQEENEPSLQSKLQDEANYHLYGSRMDRQTKQQPRQNVAYNREEERRRRVSHDPFAQQRPYENFQNTEGKGTVYSSAASHGNAVHQPSGLTSQPQVLYQNNGLYSSHGFGTRPLDPGTAGPRVWYRPIPSHMPSLHNIPVPETNYLGNTPTMPFSSLPPTDESIKYTIYNSTGIQIGAYNYMEIGGTSSSLLDSTNTNFKEEPAAKYQAIFDNTTSLTDKHLDPIRENLGKHWKNCARKLGFTQSQIDEIDHDYERDGLKEKVYQMLQKWVMREGIKGATVGKLAQALHQCSRIDLLSSLIYVSQN

SEQ ID NO: 4912 - protein, 309 aa, Homo sapiens
MRPDRAEAPGPPAMAAGGPGAGSAAPVSSTSSLPLAALNMRVRRRLSLFLNVRTQVAADWTALAEEMDFEYLEIRQLETQADPTGRLLDAWQGRPGASVGRLLELLTKLGRDDVLLELGPSIEEDCQKYILKQQQEEAEKPLQVAAVDSSVPRTAELAGITTLDDPLGHMPERFDAFICYCPSDIQFVQEMIRQLEQTNYRLKLCVSDRDVLPGTCVWSIASELIEKRCRRMVVVVSDDYLQSKECDFQTKFALSLSPGAHQKRLIPIKYKAMKKEFPSILRFITVCDYTNPCTKSWFWTRLAKALSLP

SEQ ID NO: 4913 - protein, 309 aa, Artificial Sequence
  Synthetic Polypeptide
MRPDRAEAPGPPAMAAGGPGAGSAAPVSSTSSLPLAALNMRVRRRLSLFLNVRTQVAADWTALAEEMDFEYLEIRQLETQADPTGRLLDAWQGRPGASVGRLLELLTKLGRDDVLLELGPSIEEDCQKYILKQQQEEAEKPLQVAAVDSSVPRTAELAGITTLDDPLGHMPERFDAFICYCPSDIQFVQEMIRQLEQTNYRLKLCVSDRDVLPGTCVWSIASELIEKRCRRMVVVVSDDYLQSKECDFQTKFALSLSPGAHQKRPIPIKYKAMKKEFPSILRFITVCDYTNPCTKSWFWTRLAKALSLP

SEQ ID NO: 4914 - protein, 756 aa, Homo sapiens
MSWSPSLTTQTCGAWEMKERLGTGGFGNVIRWHNQETGEQIAIKQCRQELSPRNRERWCLEIQIMRRLTHPNVVAARDVPEGMQNLAPNDLPLLAMEYCQGGDLRKYLNQFENCCGLREGAILTLLSDIASALRYLHENRIIHRDLKPENIVLQQGEQRLIHKIIDLGYAKELDQGSLCTSFVGTLQYLAPELLEQQKYTVTVDYWSFGTLAFECITGFRPFLPNWQPVQWHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGKLNEGHTLDMDLVFLFDNSKITYETQISPRPQPESVSCILQEPKRNLAFFQLRKVWGQVWHSIQTLKEDCNRLQQGQRAAMMNLLRNNSCLSKMKNSMASMSQQLKAKLDFFKTSIQIDLEKYSEQTEFGITSDKLLLAWREMEQAVELCGRENEVKLLVERMMALQTDIVDLQRSPMGRKQGGTLDDLEEQARELYRRLREKPRDQRTEGDSQEMVRLLLQAIQSFEKKVRVIYTQLSKTVVCKQKALELLPKVEEVVSLMNEDEKTVVRLQEKRQKELWNLLKIACSKVRGPVSGSPDSMNASRLSQPGQLMSQPSTASNSLPEPAKKSEELVAEAHNLCTLLENAIQDTVREQDQSFTALDWSWLQTEEEEHSCLEQAS

SEQ ID NO: 4915 - protein, 756 aa, Artificial Sequence
  Synthetic Polypeptide
MSWSPSLTTQTCGAWEMKERLGTGGFGNVIRWHNQETGEQIAIKQCRQELSPRNRERWCLEIQIMRRLTHPNVVAARDVPEGMQNLAPNDLPLLAMEYCQGGDLRKYLNQFENCCGLREGAILTLLSDIASALRYLHENRIIHRDLKPENIVLQQGEQRLIHKIIDLGYAKELDQGELCTEFVGTLQYLAPELLEQQKYTVTVDYWSFGTLAFECITGFRPFLPNWQPVQWHSKVRQKSEVDIVVSEDLNGTVKFSSSLPYPNNLNSVLAERLEKWLQLMLMWHPRQRGTDPTYGPNGCFKALDDILNLKLVHILNMVTGTIHTYPVTEDESLQSLKARIQQDTGIPEEDQELLQEAGLALIPDKPATQCISDGKLNEGHTLDMDLVFLFDNSKITYETQISPRPQPESVSCILQEPKRNLAFFQLRKVWGQVWHSIQTLKEDCNRLQQGQRAAMMNLLRNNSCLSKMKNSMASMSQQLKAKLDFFKTSIQIDLEKYSEQTEFGITSDKLLLAWREMEQAVELCGRENEVKLLVERMMALQTDIVDLQRSPMGRKQGGTLDDLEEQARELYRRLREKPRDQRTEGDSQEMVRLLLQAIQSFEKKVRVIYTQLSKTVVCKQKALELLPKVEEVVSLMNEDEKTVVRLQEKRQKELWNLLKIACSKVRGPVSGSPDSMNASRLSQPGQLMSQPSTASNSLPEPAKKSEELVAEAHNLCTLLENAIQDTVREQDQSFTALDWSWLQTEEEEHSCLEQAS

SEQ ID NO: 4916 - protein, 745 aa, Homo sapiens
MERPPGLRPGAGGPWEMRERLGTGGFGNVCLYQHRELDLKIAIKSCRLELSTKNRERWCHEIQIMKKLNHANVVKACDVPEELNILIHDVPLLAMEYCSGGDLRKLLNKPENCCGLKESQILSLLSDIGSGIRYLHENKIIHRDLKPENIVLQDVGGKIIHKIIDLGYAKDVDQGSLCTSFVGTLQYLAPELFENKPYTATVDYWSFGTMVFECIAGYRPFLHHLQPFTWHEKIKKKDPKCIFACEEMSGEVRFSSHLPQPNSLCSLIVEPMENWLQLMLNWDPQQRGGPVDLTLKQPRCFVLMDHILNLKIVHILNMTSAKIISFLLPPDESLHSLQSRIERETGINTGSQELLSETGISLDPRKPASQCVLDGVRGCDSYMVYLFDKSKTVYEGPFASRSLSDCVNYIVQDSKIQLPIIQLRKVWAEAVHYVSGLKEDYSRLFQGQRAAMLSLLRYNANLTKMKNTLISASQQLKAKLEFFHKSIQLDLERYSEQMTYGISSEKMLKAWKEMEEKAIHYAEVGVIGYLEDQIMSLHAEIMGLQKSPYGRRQGDLMESLEQRAIDLYKQLKHRPSDHSYSDSTEMVKIIVHTVQSQDRVLKELFGHLSKLLGCKQKIIDLLPKVEVALSNIKEADNTVMFMQGKRQKEIWHLLKIACTQSSARSLVGSSLEGAVTPQTSAWLPPTSAEHDHSLSCVVTPQDGETSAQMIEENLNCLGHLSTIIHEANEEQGNSMMNLDWSWLTE

SEQ ID NO: 4917 - protein, 745 aa, Artificial Sequence
  Synthetic Polypeptide
MERPPGLRPGAGGPWEMRERLGTGGFGNVCLYQHRELDLKIAIKSCRLELSTKNRERWCHEIQIMKKLNHANVVKACDVPEELNILIHDVPLLAMEYCSGGDLRKLLNKPENCCGLKESQILSLLSDIGSGIRYLHENKIIHRDLKPENIVLQDVGGKIIHKIIDLGYAKDVDQGELCTEFVGTLQYLAPELFENKPYTATVDYWSFGTMVFECIAGYRPFLHHLQPFTWHEKIKKKDPKCIFACEEMSGEVRFSSHLPQPNSLCSLIVEPMENWLQLMLNWDPQQRGGPVDLTLKQPRCFVLMDHILNLKIVHILNMTSAKIISFLLPPDESLHSLQSRIERETGINTGSQELLSETGISLDPRKPASQCVLDGVRGCDSYMVYLFDKSKTVYEGPFASRSLSDCVNYIVQDSKIQLPIIQLRKVWAEAVHYVSGLKEDYSRLFQGQRAAMLSLLRYNANLTKMKNTLISASQQLKAKLEFFHKSIQLDLERYSEQMTYGISSEKMLKAWKEMEEKAIHYAEVGVIGYLEDQIMSLHAEIMGLQKSPYGRRQGDLMESLEQRAIDLYKQLKHRPSDHSYSDSTEMVKIIVHTVQSQDRVLKELFGHLSKLLGCKQKIIDLLPKVEVALSNIKEADNTVMFMQGKRQKEIWHLLKIACTQSSARSLVGSSLEGAVTPQTSAWLPPTSAEHDHSLSCVVTPQDGETSAQMIEENLNCLGHLSTIIHEANEEQGNSMMNLDWSWLTE

SEQ ID NO: 4918 - protein, 114 aa, Homo sapiens
MAECPTLGEAVTDHPDRLWAWEKFVYLDEKQHAWLPLTIEIKDRLQLRVLLRREDVVLGRPMTPTQIGPSLLPIMWQLYPDGRYRSSDSSFWRLVYHIKIDGVEDMLLELLPDD

SEQ ID NO: 4919 - protein, 639 aa, Artificial Sequence
  Synthetic Polypeptide
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLGTRGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIE

SEQ ID NO: 4920 - protein, 639 aa, Artificial Sequence; identical to SEQ ID NO: 4919
  Synthetic Polypeptide

SEQ ID NO: 4921 - protein, 420 aa, Artificial Sequence
  Synthetic Polypeptide
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLGTRGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVD

SEQ ID NO: 4922 - protein, 613 aa, Artificial Sequence
  Synthetic Polypeptide
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLGTRGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEGIHMGIEEKFRPFYLSQLEESVEEDVKSLKKEYSNENAVVKRMQSLQLDCVAVPSSRSNSATEQPGSLHSSQGLGMGPVEESWFAPSLEHPQEENEPSLQSKLQDEANYHLYGSRMDRQTKQQPRQNVAYNREEERRRRVSHDPFAQQRPYENFQNTEGKGTVYSSAASHGNAVHQPSGLTSQPQVLYQNNGLYSSHGFGTRPLDPGTAGPRVWYRPIPSHMPSLHNIPVPETNYLGNTPTMPFSSLPPTDESIKYTIYNSTGIQIGAYNYMEIGGTSSSLLDSTNTNFKEEPAAKYQAIFDNTTSLTDKHLDPIRENLGKHWKNCARKLGFTQSQIDEIDHDYERDGLKEKVYQMLQKWVMREGIKGATVGKLAQALHQCSRIDLLSSLIYVSQN

SEQ ID NO: 4923 - protein, 171 aa, Artificial Sequence
  Synthetic Polypeptide
MDWIWRILFLVGAATGAHSFEGGTRFEGGLEIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 4924 - protein, 204 aa, Artificial Sequence
  Synthetic Polypeptide
MDWIWRILFLVGAATGAHSFEGGTREDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 4925 - protein, 448 aa, Artificial Sequence
  Synthetic Polypeptide
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSRVGGSGVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILASWKDASGWS

SEQ ID NO: 4926 - protein, 447 aa, Artificial Sequence
  Synthetic Polypeptide
MALPVTALLLPLALLLHAARPDDIQMTQSSSSFSVSLGDRVTITCMASEDIYIRLAWYQQKPGNAPRLLISAATSLETGVPSRFSGSGSGKDYTLSITSLQTEDVGTYYCQQYWSSPWTFGGGTKLEINGGGGSGGGGSGGGGSDVQLQESGPGLVKPSQSLSLTCTVTGYSITSDYTWNWIRQFPGNKLEWMGYITYSGSTSYNPSLKSRNSITRDTSKNQFFLQLNSVTTEDTATYYCARLGRRYTMDYWGQGTSVTVSSTRGGSGVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILASWKDASGWS

SEQ ID NO: 4927 - protein, 483 aa, Artificial Sequence
  Synthetic Polypeptide
MPPPRLLFFLLFLTPMEVRPDYKDDDDKEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGGWTRGGSGVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILASWKDASGWS

SEQ ID NO: 4928 - protein, 675 aa, Artificial Sequence
  Synthetic Polypeptide
MPSWALFMVTSCLLLAPQNLAQVSSQDVSLLASDSEPLKCFSRTFEDLTCFWDEEEAAPSGTYQLLYAYPREKPRACPLSSQSMPHFGTRYVCQFPDQEEVRLFFPLHLWVKNVFLNQTRTQRVLFVDSVGLPAPPSIIKAMGGSQPGELQISWEEPAPEISDFLRYELRYGPRDPKNSTGPTVIQLIATETCCPALQRPHSASALDQSPCAQPTMPWQDGPKQTSPSREASALTAEGGSCLISGLQPGNSYWLQLRSEPDGISLGGSWGSWSLPVTVDLPGDAVALGLQCFTLDLKNVTCQWQQQDHASSQGFFYHSRARCCPRDRYPIWENCEEEEKTNPGLQTPQFSRCHFKSRNDSIIHILVEVTTAPGTVHSYLGSPFWIHQAVRLPTPNLHWREISSGHLELEWQHPSSWAAQETCYQLRYTGEGHQDWKVLEPPLGARGGTLELRPRSRYRLQLRARLNGPTYQGPWSSWSDPTRVETATETATRGGSGVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILASWKDASGWS

SEQ ID NO: 4929 - protein, 914 aa, Artificial Sequence
  Synthetic Polypeptide encoding a CAR with optional accessory module(s)
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSRVEQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 4930 - protein, 914 aa, Artificial Sequence
  Synthetic Polypeptide encoding a CAR with optional accessory module(s)
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 4931 - protein, 914 aa, Artificial Sequence
  Synthetic Polypeptide encoding a CAR with optional accessory module(s)
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 4932 - protein, 915 aa, Artificial Sequence
  Synthetic Polypeptide encoding a CAR with optional accessory module(s)
MALPVTALLLPLALLLHAARPDEIVLTQSPATLSLSPGERATLSCSASSSVSYMHWYQQKPGQAPRLLIYDTSKLASGIPARFSGSGSGTDFTLTISSLEPEDVAVYYCFQGSVYPFTFGQGTKLEIKRGGGGSGGGGSGGGGSQVQLQESGPGLVKPSQTLSLTCTVSGGSISTSGMGVGWIRQHPGKGLEWIGHIWWDDDKRYNPALKSRVTISVDTSKNQFSLKLSSVTAADTAVYYCARMELWSYYFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 4933 - protein, 922 aa, Artificial Sequence
  Synthetic Polypeptide encoding a CAR with optional accessory module(s)
MALPVTALLLPLALLLHAARPDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 4934 - protein, 921 aa, Artificial Sequence
  Synthetic Polypeptide encoding a CAR with optional accessory module(s)
MALPVTALLLPLALLLHAARPDIVMTQAAPSIPVTPGESVSISCRSSKSLLNSNGNTYLYWFLQRPGQSPQLLIYRMSNLASGVPDRFSGSGSGTAFTLRISRVEAEDVGVYYCMQHLEYPFTFGAGTKLELKRGGGGSGGGGSGGGGSEVQLQQSGPELIKPGASVKMSCKASGYTFTSYVMHWVKQKPGQGLEWIGYINPYNDGTKYNEKFKGKATLTSDKSSSTAYMELSSLTSEDSAVYYCARGTYYYGSRVFDYWGQGTTLTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 4935 - protein, 919 aa, Artificial Sequence
  Synthetic Polypeptide encoding a CAR with optional accessory module(s)
MALPVTALLLPLALLLHAARPEIVLTQSPDFQSVTPKEKVTITCRASESVDTFGISFMNWFQQKPDQSPKLLIHAASNQGSGVPSRFSGSGSGTDFTLTINSLEAEDAATYYCQQSKEVPFTFGGGTKVEIKGGGGSGGGGSGGGGSEVQLVESGGGLVQPGGSLRLSCAASGFTFSSSWMNWVRQAPGKGLEWVGRIYPGDGDTNYNGKFKGRFTISRDDSKNSLYLQMNSLKTEDTAVYYCARSGFITTVLDFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 4936 - protein, 915 aa, Artificial Sequence
  Synthetic Polypeptide encoding a CAR with optional accessory module(s)
MALPVTALLLPLALLLHAARPAIQLTQSPSSLSASVGDRVTITCRASQGISSAQQKPGKAPKLLILAWYSSLESGVPSRFSGYDASGSGTDFTLTISSLQPEDFATYYCQQFNSYPYTFGQGTKLEIKGGGGSGGGGSGGGGSEVQLVQSGAEVKKPGESLKISCKGSGYSFSSSWIGWVRQMPGKGLEWMGIIYPDDSDTRYSPSFQGQVTISADKSIRTAYLQWSSLKASDTAMYYCARHVTMIWGVIIDFWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 4937 - protein, 939 aa, Artificial Sequence
  Synthetic Polypeptide encoding a CAR with optional accessory module(s)
MALPVTALLLPLALLLHAARPINIYNAEPANPSEKNSPEFDIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIKGGGGSGGGGSGGGGSEVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 4938 - protein, 921 aa, Artificial Sequence
  Synthetic Polypeptide encoding a CAR with optional accessory module(s)
MALPVTALLLPLALLLHAARPDILLTQSPATLSLSPGERATLSCRASQSVDYDGDSYLNWYQQKPGQPPKLLIYDASNLVSGIPPRFSGSGSGTDFTLTISRLEPEDFAVYHCQQSTEDPWTFGGGTKLEIKGGGGSGGGGSGGGGSQVQLVESGGGLVEPGGSLRLSCMSGYAFSSYWMNWVRQMPGKGLEWMGQIWPGDGDTNYNPSLKSRVTITADESTSTAYMELSSLKAEDTAVYFCARRETTTVGRYYYAMDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 4939 - protein, 918 aa, Artificial Sequence
  Synthetic Polypeptide encoding a CAR with optional accessory module(s)
MALPVTALLLPLALLLHAARPDILLTQSPATLSLSPGERATLSCRASQSVDNYGISFMNWYQQKPGQPPKLLIYAASNQGSGIPSRFSGSGSGTDFTLTISSLEPEDFAMYFCQQSNEVPRTFGGGTKLEIKGGGGSGGGGSGGGGSQVQLVESGGGLVEPGGSLRLSCMSGYAFSSSWMNWVRQMPGKGLEWMGRIYPGDGDTNYNGKFKERVTITADESTSTAYMELSSLKAEDTAVYFCARSEYWGNYWAMDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 4940 - protein, 917 aa, Artificial Sequence
  Synthetic Polypeptide encoding a CAR with optional accessory module(s)
MALPVTALLLPLALLLHAARPDILLTQSPATLSLSPGERATLSCKASQNVGTNVAWYQQKPGQPPKLLIYSATYRNSGIPARFSGSGSGTEFTLTITNVQSKDLADYFYFCQYNRYPYTSGGGTKLEIKRGGGGSGGGGSGGGGSQVQLVESGGGLVEPGGSLRLSCMSGYAFSSYWMNWVRQMPGKGLEWMGQIYPGDGDTNYNGKFKGRVTITADESTSTAYMELSSLKAEDTAVYFCARKTISSVVDFYFDNWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 4941 - protein, 930 aa, Artificial Sequence
  Synthetic Polypeptide encoding a CAR with optional accessory module(s)
MALPVTALLLPLALLLHAARPINIYNAEPANPSEKNSPEFQIVLTQSPATLSASPGEKATMTCSASSGVNYMHWYQQKPGTSPKRWIYDTDKTASGVPARFSGSGSGTSYSLTISSMEAEDAATYYCHQRGSYTFGGGTKLEIKGGGGSGGGGSGGGGSQVQLEQPGAEVVKPGASVKVSCKTSGYTFTSNWMHWVKQTPGKGLEWIGEIDPSDSYTNYNQKFDGKAKLTVDKSSSTAYMEVSDLTAEDSATYYCARGSNPYYYAMDYWGQGTSVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 4942 - protein, 916 aa, Artificial Sequence
  Synthetic Polypeptide encoding a CAR with optional accessory module(s)
MALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRGGGGSGGGGSGGGGSQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 4943 - protein, 924 aa, Artificial Sequence
  Synthetic Polypeptide encoding a CAR with optional accessory module(s)
MALPVTALLLPLALLLHAARPDDIQLTQSPSSLSASVGDRVTITCKASQSVDYDGDSYLNWYQQIPGKAPKLLIYDASNLVSGIPPRFSGSGSGTDYTFTISSLQPEDIATYHCQQSTEDPWTFGGGTKLQIKRGGGGSGGGGSGGGGSQVQLQQSGAEVKKPGSSVKVSCKASGYAFSSYWMNWVRQRPGQGLEWIGQIWPGDGDTNYNGKFKGRATITADESTNTAYMELSSLRSEDTAFYSCARRETTTVGRYYYAMDYWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 4944 - protein, 915 aa, Artificial Sequence
  Synthetic Polypeptide encoding a CAR with optional accessory module(s)
MALPVTALLLPLALLLHAARPQSVLTQPASVSGSPGQSITISCTGTSSDVGGYNYVSWYQQHPGKAPKLMIYDVNNRPSEVSNRFSGSKSGNTASLTISGLQAEDEADYYCSSYTTGSRAVFGGGTKLTVLGGGGGSGGGGSGGGGSEVQLVQSGAEVKKPGESLTISCKASGYSFPNYWITWVRQMSGGGLEWMGRIDPGDSYTTYNPSFQGHVTISIDKSTNTAYLHWNSLKASDTAMYYCARYYVSLVDIWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 4945 - protein, 921 aa, Artificial Sequence
  Synthetic Polypeptide encoding a CAR with optional accessory module(s)
MALPVTALLLPLALLLHAARPQSVVTQPPSVSAAPGQKVTISCSGSSSNIGNNYVSWYQQLPGTAPKLLIYDNNKRPSGIPDRFSGSKSGTSATLGITGLQTGDEADYYCGTWDGSLYTMLFGGGTKLTVLGGGGSGGGGSGGGGSEVQLVESGGGLVKPGGSLRLSCAASGFTFSNAWMSWVRQAPGKGLEWVGFIRSKAYGGTTEYAASVKGRFTISRDDSKSIAYLQMNNLKTEDTAVYYCARDGLYSSSWYDSDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 4946 - protein, 926 aa, Artificial Sequence
  Synthetic Polypeptide encoding a CAR with optional accessory module(s)
MALPVTALLLPLALLLHAARPQSVLTQPPSVSGAPGQRVTISCTGSSSNIGAGYDVHWYQQLPGTAPKLLIFGNSNRPSGVPDRFSGFKSGTSASLAITGLQAEDEADYFCQSYDSSLSGSGVFGTGTKVTVLGGGGGSGGGGSGGGGSQMQLVQSGGGLVQPGRSLRLSCAASGFTFDDYAMHWVRQAPGKGLEWVSGISWNSGSIGYADSVKGRFTISRDNAKNSLYLQMNSLRAEDTALYYCAKDIHSGSYYGLLYYAMDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 4947 - protein, 913 aa, Artificial Sequence
  Synthetic Polypeptide encoding a CAR with optional accessory module(s)
MALPVTALLLPLALLLHAARPDYIHVTQSPSSLSVSIGDRVTINCQTSQGVGSDLHWYQHKPGRAPKLLIHHASSVEDGVPSRFSGTGFHTSFNLTINDLQADDIGTYYCQVLQSFGRGSRLDTKGGGGSGGGGSGGGGSRAHLVQSGTAMKKPGASVRVSCQTSGYTFTAHILFWFRQAPGRGLEWVGWIKPQYGAVNFGGGFRDRVTLTRDVYREIAYMDIRGLKPDDTAVYYCARDRSYGDSSWALDAWGQGTTVVVSATREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 4948 - protein, 923 aa, Artificial Sequence
  Synthetic Polypeptide encoding a CAR with optional accessory module(s)
MALPVTALLLPLALLLHAARPDVQMIQTPDSLAVSLGQRATISCRASESVDNYGISFMHWYQQKPGQSPKLLIYRASNLESGIPARFSGSGSRTDFTLTINPVETDDVATYYCQQNNKDPPTFGGGTKLEIKGGGGSGGGGSGGGGSGGGGSQVQLQQSGAELVKPGASVKISCKASGYAFSSYWMNWVKQRPGKGLEWIGQIYPGDGDTTYNGKFKGKATLTADKSSSTVYMQLNSLTSEDSAVYFCVRYYYGSSGYFDYWGQGTTLTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 4949 - protein, 914 aa, Artificial Sequence
  Synthetic Polypeptide encoding a CAR with optional accessory module(s)
MALPVTALLLPLALLLHAARPDVQMIQTPSSLSASLGDRVTISCRASQDIGNYLNWYQQKPDGTVKLLIYYTSRLHSGVPSRFSGSGSGTEYSLTISNLEQEDIATYFCQQGSALPPTFGGGTKLEINGGGGSGGGGSGGGGSALQLQQSGAELVRPGASVTLSCKASGYTFTDYEMHWVKQTPVHGLEWIGAIDPETGGTAYNQKFEGKAILTADKSSSTAYMELRSLTSEDSPVYYCARRRYYGSSSFDYWGQGTTLTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 4950 - protein, 921 aa, Artificial Sequence
  Synthetic Polypeptide encoding a CAR with optional accessory module(s)
MRLPAQLLGLLMLWVSGSSGDVVMTQSPLSLPVTPGAPASISCRSSQSIVHSNGNTYLEWYLQKPGQSPKLLIYKVSNRFSGVPDRFSGSGSGTDFTLRISRVEAEDVGIYYCFQGSHVPPTFGPGTKLEIKGGGGSGGGGSGGGGSEVQLVESGGGLVQPGGSLRLSCSASGFTFSSFGMHWVRQAPGKGLEWVAYISSGSSTIYYGDTVKGRFTISRDNAKNSLFLQMSSLRAEDTAVYYCAREGGYYYGRSYYTMDYWGQGTTVTVSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 4951 - protein, 946 aa, Artificial Sequence
  Synthetic Polypeptide encoding a CAR with optional accessory module(s)
MALPVTALLLPLALLLHAARPARKRTQPTFGFTVNWKFSESTTVFTGQCFIDRNGKEVLKTMWLLRSSVNDIGDDWKATRVGINIFTRLRTQKEGGSGGSARKCSLTGKWTNDLGSNMTIGAVNSRGEFTGTYITAVTATSNEIKESPLHGTQNTINKSGGSTTVFTGQCFIDRNGKEVLKTMWLLRSSVNDIGDDWKATRVGINIFTRLRTQKEGGSGGSARKCSLTGKWTNDLGSNMTIGAVNSRGEFTGTYITAVTATSNEIKESPLHGTQNTINKRTQPTFGFTVNWKFSETREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 4952 - protein, 918 aa, Artificial Sequence
  Synthetic Polypeptide encoding a CAR with optional accessory module(s)
MALPVTALLLPLALLLHAARPDIVLTQSPASLAVSLGQRATISCRASKSVSTSGYSYLHWYQQKPGQPPKLLIYLASNLESGVPARFSGSGSGTDFTLNIHPVEEEDAATYYCQHSRELPFTFGSGTKLEIKGGGGSGGGGSGGGGSQVQLVESGGGLVQPGGSLKLSCAASGFDFSRYWMSWVRQAPGKGLEWIGEINPTSSTINFTPSLKDKVFISRDNAKNTLYLQMSKVRSEDTALYYCARGNYYRYGDAMDYWGQGTSVTVSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 4953 - protein, 916 aa, Artificial Sequence
  Synthetic Polypeptide encoding a CAR with optional accessory module(s)
MALPVTALLLPLALLLHAARPDIQMTQSPSSLSASVGDRVTITCSASQDISNYLNWYQQKPGKAPKLLIYYTSNLHSGVPSRFSGSGSGTDFTLTISSLQPEDFATYYCQQYRKLPWTFGQGTKLEIKRGGGGSGGGGSGGGGSQVQLVQSGAEVKKPGSSVKVSCKASGGTFSNYWMHWVRQAPGQGLEWMGATYRGHSDTYYNQKFKGRVTITADKSTSTAYMELSSLRSEDTAVYYCARGAIYDGYDVLDNWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 4954 - protein, 916 aa, Artificial Sequence
  Synthetic Polypeptide encoding a CAR with optional accessory module(s)
MALPVTALLLPLALLLHAARPDIVLTQSPATLSLSPGDRATISCRASESVTILGSHLIYWYQQKPGQPPRLLIQLASNVQTGVPARFSGSGSRTDFTLTISSVEPEDFAVYYCLQSRTIPRTFGQGTKLEIKRGGGGSGGGGSGGGGSQVQLVQSGPEVKKPGESVKISCKASGYTFRHYSMNWVKQAPGQGLKWMGRINTESGVPIYADDFKGRFSFTVDTSASTAYLEISSLTSEDTAVYFCSNDYLYSLDFWGQGTTLTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 4955 - protein, 917 aa, Artificial Sequence
  Synthetic Polypeptide encoding a CAR with optional accessory module(s)
MALPVTALLLPLALLLHAARPQSVLTQPPSVSGAPGQRVTISCTGSSSNIGAGFDVHWYQQLPGTAPKLLIYGNSNRPSGVPDRFSGSKSGTSASLAITGLQAEDEADYYCQSYDSSLSGYVFGTGTKVTVLGGGGGSGGGGSGGGGSQVQLVQSGAEVKKPGASVKVSCKASGYTFTDYYMHWVRQAPGQRLEWMGWINPNSGGTNYAQKFQDRITVTRDTSSNTGYMELTRLRSDDTAVYYCARSPYSGVLDKWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 4956 - protein, 915 aa, Artificial Sequence
  Synthetic Polypeptide encoding a CAR with optional accessory module(s)
MALPVTALLLPLALLLHAARPQAVLTQPPSASGTPGQRVTISCSGSSSNIGSYTVSWYQQLPGTAPKFLIYSNNQRPSGVPDRFSGSKSGTSASLAISGLQSEDEADYYCAAWDDSLNGYVFGTGTKVTVLGGGGGSGGGGSGGGGSEVQLVQSGAEVKKPGESLKISCKGSGYDFTTYWIGWVRQMPGKGLEWMGIIYPGDSDTRYSPSVRGRVTISADKSINTAYLQWSSLEASDTAMYYCARMWTFSQDGWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 4957 - protein, 926 aa, Artificial Sequence
  Synthetic Polypeptide encoding a CAR with optional accessory module(s)
MALPVTALLLPLALLLHAARPLPVLTQPPSASGTPGQRVTISCSGRSSNIGSNSVNWYRQLPGAAPKLLIYSNNQRPPGVPVRFSGSKSGTSASLAISGLQSEDEATYYCATWDDNLNVHYVFGTGTKVTVLGSRGGGGSGGGGSGGGGSLEMAQVQLVQSGAEVKKPGSSVKVSCKASGGTFSSYAISWVRQAPGQGLEWMGRIIPILGIANYAQKFQGRVTITADKSTSTAYMELSSLRSEDTAVYYCARGGYYSHDMWSEDWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 4958 - protein, 915 aa, Artificial Sequence
  Synthetic Polypeptide encoding a CAR with optional accessory module(s)
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRIFPRTFGQGTKLEIKGGGGSGGGGSGGGGSQVQLVQSGSELKKPGESVKISCKASGYTFTDYSINWVKQAPGQGLKWMGWINTETREPAYAYDFRGRFVFSLDTSASTAYLQISSLKAEDTAVYFCALDYSYAMDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 4959 - protein, 916 aa, Artificial Sequence
  Synthetic Polypeptide encoding a CAR with optional accessory module(s)
MALPVTALLLPLALLLHAARPDIVLTQSPATLSLSPGDRATLSCRASESVTILGSHLIYWYQQKPGQAPRLLIQLASNVQTGIPARFSGSGSRTDFTLTISSLEPEDFAVYYCLQSRTIPRTFGQGTKLEIKRGGGGSGGGGSGGGGSQVQLVQSGSELKKPGESVKISCKASGYTFTHYSMNWVRQAPGQGLEWMGRINTETGEPLYADDFKGRFVFSLDTSASTAYLQISSLKAEDTAVYYCSNDYLYSLDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 4960 - protein, 917 aa, Artificial Sequence
  Synthetic Polypeptide encoding a CAR with optional accessory module(s)
MALPVTALLLPLALLLHAARPDIVMTQSPDSLAVSLGERATINCKSSQSILYSSNQKNYLAWYQQKPGQSPKLLIYWASTRESGVPDRFSGSGSGTDFTLTISSLQAEDVAVYYCHQYISSYTFGQGTKLEIKGGGGSGGGGSGGGGSQVQLVQSGAEVKKPGASVKVSCKASGYTFASQWMHWMRQAPGQGLEWIGWINPGNVNTKYNEKFKGRATLTVDTSTNTAYMELSSLRSEDTAVYYCARSTWYRPLDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 4961 - protein, 1041 aa, Artificial Sequence
  Synthetic Polypeptide encoding a CAR with optional accessory module(s)
MVRGVPFRHLLLVLQLALLPAATQGKKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASGGGGSGGGGSGGGGSIYQELTQLKAAVERLCHPCPWEWTFFQGNCYFMSNSQRNWHDSITACKEVGAQLVVIKSAEEQNFLQLQSSRSNRFTWMGLSDLNQEGTWQWVDGSPLLPSFKQYWNRGEPNNVGEEDCAEFSGNGWNDDKCNLAKFWICKKSAASCSRDEEQFLSPAPATPNPPPATREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 4962 - protein, 917 aa, Artificial Sequence
  Synthetic Polypeptide encoding a CAR with optional accessory module(s)
MALPVTALLLPLALLLHAARPDHIVLTQSPSSLSASLGDRVTISCRASQDISTYLNWYQQKPDGTVKLLIFYTSRLHAGVPSRFSGSGSGTHHSLTISNLEQEDIATYFCQQGNSLPFTFGSGTKLEIKRGGGGSGGGGSGGGGSQVQLKESGPELEKPGASVKISCKASGYSFTAYSMNWVKQNNGMSLEWIGSIDPYYGDTKYAQKFKGKATLTVDKASSTAYLQLKSLTSEDSAVYYCARRMITTGDWYFDVWGAGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 4963 - protein, 917 aa, Artificial Sequence; identical to SEQ ID NO: 4962
  Synthetic Polypeptide encoding a CAR with optional accessory module(s)

SEQ ID NO: 4964 - protein, 864 aa, Artificial Sequence
  Synthetic Polypeptide encoding a CAR with optional accessory module(s)
MALPVTALLLPLALLLHAARPGMRTEDLPKAVVFLEPQWYRVLEKDSVTLKCQGAYSPEDNSTQWFHNESLISSQASSYFIDAATVDDSGEYRCQTNLSTLSDPVQLEVHIGWLLLQAPRWVFKEEDPIHLRCHSWKNTALHKVTYLQNGKGRKYFHHNSDFYIPKATLKDSGSYFCRGLVGSKNVSSETVNITITQGLAVSTISSFFPPGYQTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 4965 - protein, 864 aa, Artificial Sequence; identical to SEQ ID NO: 4964
  Synthetic Polypeptide encoding a CAR with optional accessory module(s)

SEQ ID NO: 4966 - protein, 917 aa, Artificial Sequence
  Synthetic Polypeptide encoding a CAR with optional accessory module(s)
MALPVTALLLPLALLLHAARPDEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKGGGGSGGGGSGGGGSEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 4967 - protein, 919 aa, Artificial Sequence
  Synthetic Polypeptide encoding a CAR with optional accessory module(s)
MALPVTALLLPLALLLHAARPDIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKRGGGGSGGGGSGGGGSQVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 4968 - protein, 916 aa, Artificial Sequence
  Synthetic Polypeptide encoding a CAR with optional accessory module(s)
MALPVTALLLPLALLLHAARPDIVLTQSPAIITASPGEKVTMTCRASSSVNYMDWYQKKPGSSPKPWIYATSNLASGVPSRFSGSGSGTTYSMTISSLEAEDAATYYCQQWSFNPPTFGGGTKLEIKRGGGGSGGGGSGGGGSEVQLQQSGAELKKPGASVKVSCKASGYTFTSYNMHWVKQTPGQGLEWIGAIYPGNGDTSYNQKFKGKTTLTADKSSSTAYMELSSLRSEDTAVYYCARSNYYGSSYWFFDVWGTGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 4969 - protein, 919 aa, Artificial Sequence
  Synthetic Polypeptide encoding a CAR with optional accessory module(s)
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSDWPLTFGGGTKVEIKGGGGSGGGGSGGGGSEVQLVQSGGGLVHPGGSLRLSCTGSGFTFSYHAMHWVRQAPGKGLEWVSIIGTGGVTYYADSVKGRFTISRDNVKNSLYLQMNSLRAEDMAVYYCARDYYGAGSFYDGLYGMDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 4970 - protein, 917 aa, Artificial Sequence
  Synthetic Polypeptide encoding a CAR with optional accessory module(s)
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGGGTKVEIKGGGGSGGGGSGGGGSAVQLVESGGGLVQPGRSLRLSCAASGFTFGDYTMHWVRQAPGKGLEWVSGISWNSGSIGYADSVKGRFTISRDNAKNSLYLQMNSLRAEDTALYYCTKDNQYGSGSTYGLGVWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 4971 - protein, 916 aa, Artificial Sequence
  Synthetic Polypeptide encoding a CAR with optional accessory module(s)
MALPVTALLLPLALLLHAARPDIQMTQSPSSLSASVGDRVTITCRASSSVSYMHWYQQKPGKAPKPLIYAPSNLASGVPSRFSGSGSGTDFTLTISSLQPEDFATYYCQQWSFNPPTFGQGTKVEIKRGGGGSGGGGSGGGGSEVQLVESGGGLVQPGGSLRLSCAASGYTFTSYNMHWVRQAPGKGLEWVGAIYPGNGDTSYNQKFKGRFTISVDKSKNTLYLQMNSLRAEDTAVYYCARVVYYSNSYWYFDVWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 4972 - protein, 914 aa, Artificial Sequence
  Synthetic Polypeptide encoding a CAR with optional accessory module(s)
MALPVTALLLPLALLLHAARPDIQLTQSPSSLSASVGDRVTMTCRASSSVSYIHWFQQKPGKAPKPWIYATSNLASGVPVRFSGSGSGTDYTFTISSLQPEDIATYYCQQWTSNPPTFGGGTKLEIKGGGGSGGGGSGGGGSQVQLQQSGAEVKKPGSSVKVSCKASGYTFTSYNMHWVKQAPGQGLEWIGAIYPGNGDTSYNQKFKGKATLTADESTNTAYMELSSLRSEDTAFYYCARSTYYGGDWYFDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 4973 - protein, 926 aa, Artificial Sequence
  Synthetic Polypeptide encoding a CAR with optional accessory module(s)
MALPVTALLLPLALLLHAARPSTVMTQSPDSLAVSLGERATINCKSSQSNSNDVAWYQQKPGQSPKVLIYFASNRYSGVPDRFSGSGYGTDFTLTISSLQAEDVAVYFCQQDYSSPLTFGAGTKLELKRADAGGGGSGGGGSGGGGSQIQLVQSGSELKKPGASVKVSCKASGYTFTNFGVNWVRQAPGKGLEWMGWINTYTGEPSYAQGFTGRFVFSLDASVSTAYLQISSLKAEDTATYFCTRRTNYYGTSYYYAMDYWGQGTTVTVSSAKTTTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 4974 - protein, 918 aa, Artificial Sequence
  Synthetic Polypeptide encoding a CAR with optional accessory module(s)
MALPVTALLLPLALLLHAARPQIVLSQSPAILSASPGEKVTMTCRASSSVSYMHWYQQKPGSSPKPWIYATSNLASGVPARFSGSGSGTSYSFTISRVEAEDAATYYCQQWTFNPPTFGGGTRLEIKRTVAAGGGGSGGGGSGGGGSQAYLQQSGAELVRPGASVKMSCKASGYTFTSYNMHWVKQTPRQGLEWIGGIYPGNGDTSYNQKFKGKATLTVGKSSSTAYMQLSSLTSEDSAVYFCARYDYNYAMDYWGQGTSVTVSSASTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 4975 - protein, 916 aa, Artificial Sequence; identical to SEQ ID NO: 4971
  Synthetic Polypeptide encoding a CAR with optional accessory module(s)

SEQ ID NO: 4976 - protein, 915 aa, Artificial Sequence
  Synthetic Polypeptide encoding a CAR with optional accessory module(s)
MALPVTALLLPLALLLHAARPEIVLTQSPSSLSASVGDRVTITCRASSSLSFMHWYQQKPGKAPKPWIYATSNLASGVPSRFSGSGSGTDYTLTISSLQPEDFATYFCHQWSSNPLTFGGGTKVEIKGGGGSGGGGSGGGGSQVQLVQSGAEVKKPGASVKVSCKASGYTFTSYNMHWVRQAPGQRLEWIGAIYPGNGDTSYNQKFKGRVTVTRDTSANTAYMELSSLKSEDTAVYYCARSHYGSNYVDYFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 4977 - protein, 917 aa, Artificial Sequence
  Synthetic Polypeptide encoding a CAR with optional accessory module(s)
MALPVTALLLPLALLLHAARPDEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKGGGGSGGGGSGGGGSEVQLVESGGGLVQPDRSLRLSCAASGFTFHDYAMHWVRQAPGKGLEWVSTISWNSGTIGYADSVKGRFTISRDNAKNSLYLQMNSLRAEDTALYYCAKDIQYGNYYYGMDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 4978 - protein, 915 aa, Artificial Sequence
  Synthetic Polypeptide encoding a CAR with optional accessory module(s)
MALPVTALLLPLALLLHAARPEIVLTQSPGTLSLSPGERATLSCRASSSVPYIHWYQQKPGQAPRLLIYATSALASGIPDRFSGSGSGTDFTLTISRLEPEDFAVYYCQQWLSNPPTFGQGTKLELKRGGGGSGGGGSGGGGSEVQLVQSGAEVKKPGESLKLSCKGSGRTFTSYNMHWVRQMPGKGLEWMGAIYPLTGDTSYNQKSKLQVTISADKSISTAYLQWSSLKASDTAMYYCARSTYVGGDWQFDVWGKGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 4979 - protein, 920 aa, Artificial Sequence
  Synthetic Polypeptide encoding a CAR with optional accessory module(s)
MALPVTALLLPLALLLHAARPDIQMTQSPSSLSASVGDRVTITCRSSQSIVHSVGNTFLEWYQQKPGKAPKLLIYKVSNRFSGVPSRFSGSGSGTDFTLTISSLQPEDFATYYCFQGSQFPYTFGQGTKVEIKRGGGGSGGGGSGGGGSEVQLVESGGGLVQPGGSLRLSCAASGYEFSRSWMNWVRQAPGKGLEWVGRIYPGDGDTNYSGKFKGRFTISADTSKNTAYLQMNSLRAEDTAVYYCARDGSSWDWYFDVWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 4980 - protein, 912 aa, Artificial Sequence
  Synthetic Polypeptide encoding a CAR with optional accessory module(s)
MALPVTALLLPLALLLHAARPDIVMTQSPSSLSASVGDRVTITCKASQSVTNDVAWYQQKPGKAPKLLIYYASNRYTGVPSRFSGSGSGTDFTLTISSLQPEDFATYYCQQDYRSPWTFGGGTKVEIKRGGGGSGGGGSGGGGSQVQLEESGGGVVRPGRSLRLSCAASGFTFSDYGVNWIRQAPGKGLEWVTIIWGDGRTDYNSALKSRFTVSRNNSNNTLSLQMNSLTTEDTAVYYCVRAPGNRAMEYWGQGVLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 4981 - protein, 918 aa, Artificial Sequence
  Synthetic Polypeptide encoding a CAR with optional accessory module(s)
MALPVTALLLPLALLLHAARPDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQIFGQGTKLEIKGGGGSGGGGSGGGGSQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 4982 - protein, 918 aa, Artificial Sequence
  Synthetic Polypeptide encoding a CAR with optional accessory module(s)
MALPVTALLLPLALLLHAARPQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSGGGGSGGGGSGGGGSDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQIFGQGTKLEIKTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 4983 - protein, 911 aa, Artificial Sequence
  Synthetic Polypeptide encoding a CAR with optional accessory module(s)
MALPVTALLLPLALLLHAARPDIQMTQSPATIENTSLSASVGDRVTITCRASQGISSWLTWYQQKPEKAPKSLIYAASSLQSGVPSRFSGSGSGTDFTLTISSLQPEDFATYYCQQYDSYPITFGQGTRLEIKGGGGSGGGGSGGGGSQVQLQQWGAGLLKPSETLSLTCAVYGGSFSAYYWSWIRQPPGKGLEWIGDINHGGGTNYNPSLKSRVTISVDTSKNQFSLKLNSVTAADTAVYYCASLTAYWGQGSLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 4984 - protein, 916 aa, Artificial Sequence
  Synthetic Polypeptide encoding a CAR with optional accessory module(s)
MALPVTALLLPLALLLHAARPDEIVLTQSPDSLAVSLGERATINCKASQSVDFDGDSYLNWYQQKPGQPPKVLIYAASTLQSGVPSRFSGSGSGTDFTLTINSLEAEDAATYYCQQSNEDPWTFGGGTKVEIKGGGGSGGGGSGGGGSQVQLVQSGAEVKKPGASVKVSCKVSGYTFTDYYITWVRQAPGQALEWMGWIYPGSGNTKYSQKFQGRFVFSVDTSASTAYLQLSSLKAEDTAVYYCANYGNYWFAYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 4985 - protein, 913 aa, Artificial Sequence
  Synthetic Polypeptide encoding a CAR with optional accessory module(s)
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKGGGGSGGGGSGGGGSEVQLVQSGGGLVHPGGSLRLSCAGSGFAFSSSTMHWIRQAPGKGLEWISLIGSGGGIYYGDSVKGRFTISRDNAKNSLYLQMNSLRAEDMAVYYCVRGYFDWVDYFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 4986 - protein, 923 aa, Artificial Sequence
  Synthetic Polypeptide encoding a CAR with optional accessory module(s)
MALPVTALLLPLALLLHAARPDDIVMTQSPDSLTVSLGERTTINCKSSQSVLDSSKNKNSLAWYQQKPGQPPKLLLSWASTRESGIPDRFSGSGSGTDFTLTIDSLQPEDSATYYCQQSAHFPITFGQGTRLEIKGGGGSGGGGSGGGGSQVQLVQSGAEVKKPGASVKVSCKASGYTFTNYGMNWVKQAPGQGLKWMGWINTYTGEPTYADDFKGRVTMTSDTSTSTAYLELHNLRSDDTAVYYCARWSWSDGYYVYFDYWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 4987 - protein, 919 aa, Artificial Sequence
  Synthetic Polypeptide encoding a CAR with optional accessory module(s)
MALPVTALLLPLALLLHAARPDEIVLTQSPGSLAVSPGERVTMSCKSSQSVFFSSSQKNYLAWYQQIPGQSPRLLIYWASTRESGVPDRFTGSGSGTDFTLTISSVQPEDLAIYYCHQYLSSRTFGQGTKLEIKRGGGGSGGGGSGGGGSQVQLQQPGAEVVKPGASVKMSCKASGYTFTSYYIHWIKQTPGQGLEWVGVIYPGNDDISYNQKFQGKATLTADKSSTTAYMQLSSLTSEDSAVYYCAREVRLRYFDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 4988 - protein, 945 aa, Artificial Sequence
  Synthetic Polypeptide encoding a CAR with optional accessory module(s)
MALPVTALLLPLALLLHAARPYINIYNAEPANPSEKNSPTQYAYGSGEFDIQLTQSPSSLSASVGDRVTITCRASQGISSVLAWYQQKPGKAPKLLIYDASSLESGVPSRFSGSGSGTDFTLTISSLQPEDFATYYCQQFNSSITFGQGTKLEIKRTVAAGGGGSGGGGSGGGGSQVQLVQSGAEVKKPGSSVKVSCKASGGTFSDYAISWVRQAPGQGLEWMGRIIPILGVANYAQKFQGRVTITADKSTRTAYMELSSLRSEDTAVYYCARNWADAFDIWGQGTMVTVSSASTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 4989 - protein, 944 aa, Artificial Sequence
  Synthetic Polypeptide encoding a CAR with optional accessory module(s)
MALPVTALLLPLALLLHAARPYINIYNAEPANPSEKNSPTQYAYGSGEFDIVMTQSPSSLSASLGGKVTITCKASQDINKYIAWYQHKPGKGPRLLIHYTSTLQPGIPSRFSGSGSGRDYSFSISNLEPEDIATYYCLQYDNLLTFGAGTKLELKRGGGGSGGGGSGGGGSEVKLQQSGPELVKPGTSVKVSCKASGYSFTDYNMYWVKQSHGKSLEWIGYIDPYKGGTIYNQKFKGKATLTVDKSSSTAFMHLNSLTSEDSAVYYCAREMITAYYFDYWGQGSSVTVSSLERTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 4990 - protein, 960 aa, Artificial Sequence
  Synthetic Polypeptide encoding a CAR with optional accessory module(s)
MALPVTALLLPLALLLHAARPDIQMTQSPSSLSASVGDRVTINCKASQDINSYLSWFQQKPGKAPKTLIYRANRLVDGVPSRFSGSGSGQDYTLTISSLQPEDFATYYCLQYDEFPLTFGGGTKVEIKGGGGSGGGGSGGGGSQVQLVQSGAEVKKPGASVKVSCKASGYTFTNYDINWVRQAPGQGLEWIGWIYPGDGSTKYNEKFKAKATLTADTSTSTAYMELRSLRSDDTAVYYCASGYEDAMDYWGQGTTVTVSSAKPTTTPAPRPPTPAPTIASQPLSLRPEACRPAAGGAVHTRGLDFACDITREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 4991 - protein, 916 aa, Artificial Sequence
  Synthetic Polypeptide encoding a CAR with optional accessory module(s)
MALPVTALLLPLALLLHAARPEIVLTQSPLSLPVTPGEPASISCRSSQSLLHSNGYNYLDWYLQKPGQSPQLLIYLGVNSVSGVPDRFSGSGSGTDFTLKISRVEAEDVGVYYCMQALQTPWTFGQGTKVEIKGGGGSGGGGSGGGGSQVQLVQSGAEVKKPGSSVKVSCKASGGIFSNHAISWVRQAPGQGLEWMGGIIPIFGTANYAQKFQGRVTITADESTSTAFMELSSLRSEDTAVYYCAREWADVFDIWGQGTMVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 4992 - protein, 915 aa, Artificial Sequence
  Synthetic Polypeptide encoding a CAR with optional accessory module(s)
MALPVTALLLPLALLLHAARPDIQMTQSPASLTVSLGQRATISCRASESVDSYGNSYLHWYQQKPGQPPQLLIYLASNLESGVPARFSGSGSRTDFTLTIDPVEADDAATYYCQQNNEDPWTFGGGTKVEIKGGGGSGGGGSGGGGSEVQLQQSGAELVKPGASVKMSCKAFGYTFTTFPIEWMKQSHGKSLEWIGNFHPYNDQTKYNEEFKGRAKLTIDRSSSTVYLELGRLTSDDSAVYYCARGYYYAFDFWGQGTTLTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 4993 - protein, 912 aa, Artificial Sequence
  Synthetic Polypeptide encoding a CAR with optional accessory module(s)
MALPVTALLLPLALLLHAARPDIQMTQSPSSLSASVGDRVTITCRASQGIRNDLGWYQQKPGKAPKRLIYAASSLQSGVPSRFSGSGSGTEFTLTISSLQPEDFATYYCLQHNSYPWTFGQGTKLEIKGGGGSGGGGSGGGGSEVQLVESGGALIQPGGSLRLSCVASGFTISGNYMSWVRQAPGKGLEWVSLIYSGDSTYYADSVKGRFTISRDISKNTVYLQMNSLRVEDTAVYYCVRDGYYVSDMVVWGKGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 4994 - protein, 922 aa, Artificial Sequence
  Synthetic Polypeptide encoding a CAR with optional accessory module(s)
MALPVTALLLPLALLLHAARPDVLLTQSPLSLPVTLGQPASISCRSSQTIVHSNGNTYLEWFQQRPGQSPRLLIYQVSNRFSGVPDRFSGSGSGTDFTLKISRVEAEDVGVYYCFQGSHVPRTFGGGTKVEIKRGGGGSGGGGSGGGGSQIQLVQSGSELKKPGASVKVSCKASGYTFTNYGMNWVRQAPGQGLKWMGWINTNTGEPKYAEEFKGRFALSLDTSVSTAYLQINSLKAEDTAVYFCARGYGNYARGAWLAYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 4995 - protein, 909 aa, Artificial Sequence
  Synthetic Polypeptide encoding a CAR with optional accessory module(s)
MALPVTALLLPLALLLHAARPDEIVLTQSPATLSLSPGERATLSCSASSSINYIYWLQQKPGQAPRILIYLTSNLASGVPARFSGSGSGTDFTLTISSLEPEDFAVYYCLQWSSNPLTFGGGTKVEIKGGGGSGGGGSGGGGSFEVQLVESGGGLVKPGGSLRLSCAASGFTFSSYDMSWVRQAPGKGLEWVSTISSGGSYTYYLDSIKGRFTISRDNAKNSLYLQMNSLRAEDTAVYYCARQGLDYWGRGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 4996 - protein, 917 aa, Artificial Sequence
  Synthetic Polypeptide encoding a CAR with optional accessory module(s)
MALPVTALLLPLALLLHAARPDIVMTQSPDSLAVSLGERATINCRASKSVSTSGYSFMHWYQQKPGQPPKLLIYLASNLESGVPDRFSGSGSGTDFTLTISSLQAEDVAVYYCQHSREVPWTFGQGTKVEIKRGGGGSGGGGSGGGGSQVQLVQSGAEVKKPGASVKVSCKASGYTFTNYGMNWVRQAPGQGLEWMGWINTYTGEPTYADAFKGRFAFSLDTSTSTAYLQINSLRSDDTAVYYCARDYGDYGMDYWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 4997 - protein, 913 aa, Artificial Sequence
  Synthetic Polypeptide encoding a CAR with optional accessory module(s)
MALPVTALLLPLALLLHAARPDIVMTQTPLTLSVTIGQPASISCKSSQSLLDSDGKTYLNWLLQRPGQSPERLIYLVSKLDSGVPDRFTGSGSGTDFTLKISRVEAEDLGVYCCWQGTHFPYTFGGGTKVEIKGGGGGSGGGGSGGGGSQVQLQQPGAELVRPGASVKLSCKASGYTFTSYWMNWVKQRPGQGLEWIGMIDPSDSETHYNHIFKDKATLTVDKSSSTAYLQLSSLTSEDSAVYYCARNLYLWGQGTSVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 4998 - protein, 917 aa, Artificial Sequence
  Synthetic Polypeptide encoding a CAR with optional accessory module(s)
MALPVTALLLPLALLLHAARPDDIQLTQSPSSLSASVGDRVTITCKASQSVDYEGDSFLNWYQQKPGKAPKLLIYAASNLESGVPSRFSGSGSGTDFTLTISSLQPEDFATYYCQQSNEDPLTFGQGTKVEIKRGGGGSGGGGSGGGGSEVQLVESGGGLVQPGGSLRLSCAASGYTFSSYWIEWVRQAPGKGLEWIGEILPGGGDTNYNEIFKGRATFSADTSKNTAYLQMNSLRAEDTAVYYCTRRVPIRLDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 4999 - protein, 913 aa, Artificial Sequence
  Synthetic Polypeptide encoding a CAR with optional accessory module(s)
MALPVTALLLPLALLLHAARPDIVMTQTPLSLSVTPGQPASISCKSSQSLLDGDGKTYLNWLLQKPGQSPQRLIYLVSKLDSGVPDRFSGSGSGTDFTLKISRVEAEDVGVYYCWQGTHFPRTFGQGTKLEIKGGGGSGGGGSGGGGSQVQLVQSGAEVKKPGASVKVSCKASGYTFKDTYIHWVRQAPGQGLEWMGRIDPANGNTKYDPKFQGRVTMTRDTSISTAYMELSRLRSDDTAVYYCARRGGVDWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5000 - protein, 921 aa, Artificial Sequence
  Synthetic Polypeptide encoding a CAR with optional accessory module(s)
MALPVTALLLPLALLLHAARPDIVMTQSPDSLAVSLGERATINCESSQSLLNSGNQKNYLTWYQQKPGQPPKPLIYWASTRESGVPDRFSGSGSGTDFTLTISSLQAEDVAVYYCQNDYSYPYTFGQGTKLEIKRGGGGSGGGGSGGGGSEVQLVQSGAEVKKPGESLKISCKGSGYSFTDYYMKWARQMPGKGLEWMGDIIPSNGATFYNQKFKGQVTISADKSISTTYLQWSSLKASDTAMYYCARSHLLRASWFAYWGQGTMVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5001 - protein, 916 aa, Artificial Sequence
  Synthetic Polypeptide encoding a CAR with optional accessory module(s)
MALPVTALLLPLALLLHAARPDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKGGGGSGGGGSGGGGSQIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5002 - protein, 920 aa, Artificial Sequence
  Synthetic Polypeptide encoding a CAR with optional accessory module(s)
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKGGGGSGGGGSGGGGSEVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5003 - protein, 920 aa, Artificial Sequence
  Synthetic Polypeptide encoding a CAR with optional accessory module(s)
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKGGGGSGGGGSGGGGSQVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5004 - protein, 914 aa, Artificial Sequence
  Synthetic Polypeptide encoding a CAR with optional accessory module(s)
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQDYGFPWTFGQGTKVEIKRGGGGSGGGGSGGGGSEVQLVQSGAEVKKPGESLKISCKGSGYSFTSYWISWVRQMPGKGLEWMGIIDPSDSDTRYSPSFQGQVTISADKSISTAYLQWSSLKASDTAMYYCARGDGSTDLDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5005 - protein, 916 aa, Artificial Sequence
  Synthetic Polypeptide encoding a CAR with optional accessory module(s)
MALPVTALLLPLALLLHAARPQFVLTQPPSVSTNPGSTVKLSCKRNTGNIGSNYVNWYQQKPGQSPTTMIYRDDKRPDGVPDRFSGSIDRSSNSALLTINNVQTEDEADYFCQSYSSGINIIFGGGTKLTVLGGGGSGGGGSGGGGSQVQLQESGPGLVKPSETLSLTCTVSGFSLTTYDVHWVRQPPGKGLEWMGRIQNAGITDYNSALKSRLIISRDTSKSQVFLKMNSVTTADTAMYFCAKTGSYFYAFDHWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5006 - protein, 913 aa, Artificial Sequence
  Synthetic Polypeptide encoding a CAR with optional accessory module(s)
MALPVTALLLPLALLLHAARPDIQMTQSPASLSASLGETVTIECRPSEDIHSNVAWYQQKPGNSPQLLIYDASNLADGVPSRFSGSGSGTQYSLKINSLQSEDVASYFCHQYNIYPYTFGSGTKLELKGGGGSGGGGSGGGGSQVQLQESGPTLVKPGDSVKMSCKASGYTFTDYIIHWVKQSHGKSLEWIGYINPYSDGTNYNEKFKSKATLTVDKSTSTAYMEFSRLTSEDSAIYFCALNYGSYYAMDAWGQGTSVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5007 - protein, 914 aa, Artificial Sequence
  Synthetic Polypeptide encoding a CAR with optional accessory module(s)
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGQGTKVEIKRGGGGSGGGGSGGGGSEVQLLESGGGLVQPGGSLRLSCAASGFTFSGYWMHWVRQAPGKGLEWVSAIRSDGSSKYYADSVKGRFTISRDNSKNTLYLQMNSLRAEDTAVYYCAKDGVIEDTFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5008 - protein, 910 aa, Artificial Sequence
  Synthetic Polypeptide encoding a CAR with optional accessory module(s)
MALPVTALLLPLALLLHAARPDVQITQSPSYLAASPGETITINCRASKSISKDLAWYQEKPGKTNKLLIYSGSTLQSGIPSRFSGSGSGTDFTLTISSLEPEDFAMYYCQQHNKYPYTFGGGTKLEIKRGGGGSGGGGSGGGGSQVQLQQPGAELVRPGASVKLSCKASGYTFTSYWMNWVKQRPDQGLEWIGRIDPYDSETHYNQKFKDKAILTVDKSSSTAYMQLSSLTSEDSAVYYCARGNWDDYWGQGTTLTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5009 - protein, 941 aa, Artificial Sequence
  Synthetic Polypeptide encoding a CAR with optional accessory module(s)
MALPVTALLLPLALLLHAARPYINIYNAEPANPSEKNSPTQYAYGSGEFDIQMTQSPASLSASLGETVTIECRTSKDIYSNLAWFQQEPGNSPQLLIYDASNLADGVPSRFSGSGSGTQYSLQINNLQSEDVASYFCHQYNNYPYTFGTGTKLELKGGGGSGGGGSGGGGSQVQLQESGPTLVNPGDSVKMSCKASGYTFTDHIIHWVKQSHGKSLEWIGYINPYSGGANYNGKFKSKATLTIDKSSSTAYMEFSRLTSGDSAIYYCALNYGSYYAMDAWGQGTSVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5010 - protein, 912 aa, Artificial Sequence
  Synthetic Polypeptide encoding a CAR with optional accessory module(s)
MALPVTALLLPLALLLHAARPEIVLTQSPTSMTASPGEQVTITCRASSSINYMHWYQQKPGASPRPWIYETSKLASGVPDRFSGSASGTSYSLTINNMEAEDAATYYCQQWNYPSWTFGGGTKLELKGGGGSGGGGSGGGGSEVQLVESGGGLVQPGRSLKLSCAASGFTFSDYNMAWVRQAPKKGLEWVATILYDGGRTYYRGSVKGRFTISRDNAKSTLYLRMDSLRSEDTATYYCATHSRGTDYFDYWGQGVMVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5011 - protein, 921 aa, Artificial Sequence
  Synthetic Polypeptide encoding a CAR with optional accessory module(s)
MALPVTALLLPLALLLHAARPDIVMTQSPSSLAVSEGETVTINCKSSQSFLSSGDGKNYVAWYQYKPGQSPKLLIYWASTRQSGVPDRFIGSGSGTDFTLTISTVQAEDLAIYYCQQYYDTPLTFGSGTKLEIKGGGGSGGGGSGGGGSEVKLQESGPSLVQSSQTLSLTCTVSGFSLTSYHIHWVRQTPGKGLEWMGVMWSDGDTSYNSALKSRLSISRDTSQSQVFLKMNSLQTEDTATYYCARGYYSSYLYLWFAYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5012 - protein, 925 aa, Artificial Sequence
  Synthetic Polypeptide encoding a CAR with optional accessory module(s)
MALPVTALLLPLALLLHAARPDVLMTQTPVSLPVSLGGQVSISCRSSQSLVHSDGDTYLHWYLQKPGQSPQLLIYRVSNRFSGVPDRFSGSGSGTDFTLKISRVEPEDLGLYYCLQTTHFPPWTFGGGTKLEMKGGGGSGGGGSGGGGSQVQLQQSGPELRRPGSSVRLSCKASGYRIKDFLIHWIKNRPEHGLEWIGWIDPEDGETKYAQKFQTKATLTADTSSNTAYMQLSSLTSEDTATYFCARWGDVYYGLMRGHVMDAWGQGTSVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5013 - protein, 916 aa, Artificial Sequence
  Synthetic Polypeptide encoding a CAR with optional accessory module(s)
MALPVTALLLPLALLLHAARPDIQMTQSTSSLSASLGDRVTISCSASQGINNYLNWYQQKPDGTVELLIYYTSTLQSGVPSRFSGSGSGTDYSLTISNLEPEDIGTYYCQQYSKLPRTFGGGTKLEIKGGGGSGGGGSGGGGSQVQLQQSGSELMMPGASVKISCKATGYTFSNYWIEWVKQRPGHGLEWIGEILPGTGRTIYNEKFKGKATFTADISSNTVQMQLSSLTSEDSAVYYCARRDYYGNFYYAMDYWGQGTSVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5014 - protein, 911 aa, Artificial Sequence
  Synthetic Polypeptide encoding a CAR with optional accessory module(s)
MALPVTALLLPLALLLHAARPDIQMTQSPASLSVSVGETVTITCRASENIYSNLAWYQQKQGKSPQLLVYAATNLADGVPSRFSGSGSGTQYSLKINSLQSEDFGSYYCQHFWGTWTFGGGTTLEIKGGGGSGGGGSGGGGSEVQLQQSGPELVKPGASVKMSCKASGYTFTDYYMKWMKQSHGKSLEWIGDINPNNGGTTYNQKFKGKATLTVDKSSSTAYMQLNSLTSEDSAVYYCARDYGYGYFDYWGQGTTLTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5015 - protein, 914 aa, Artificial Sequence
  Synthetic Polypeptide encoding a CAR with optional accessory module(s)
MALPVTALLLPLALLLHAARPEIVLTQSPGTLSLSPGERATLSCRASQSVGGYLAWYQQKPGQAPRLLIYDASNRATGIPARFSGSGSGTDFTLTISSLEPEDFAVYYCQQRNNWPPMYTFGQGTKLEIKRGGGGSGGGGSGGGGSQVQLVQSGAEVKKPGSSVKVSCKASGGTFSSYAISWVRQAPGQGLEWMGGIIPILGTANYAQKFQGRVTITADESTSTAYMELSSLRSEDTAVYYCARWGGGAFDIWGQGTMVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5016 - protein, 909 aa, Artificial Sequence
  Synthetic Polypeptide encoding a CAR with optional accessory module(s)
MALPVTALLLPLALLLHAARPQIVLTQSPALMSASPGEKVTMTCSASSSVRYMYWYQQKPRSSPKPWIHLTSNLASGVPARFSGSGSGTSYSLTISSMEAEDAATYYCQQWSSHPFTFGSGTKLEIKGGGGSGGGGSGGGGSDVQLQESGPGLVKPSQSLSLTCTVTGFSITSDYSWNWIRQFPGNKLEWMGYISYSGHTSYNPSLESRISITRDTSKNQFFLQLNSVTTEDTATYYCTRGNWDVVYWGQGTLVTVSATREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5017 - protein, 919 aa, Artificial Sequence
  Synthetic Polypeptide encoding a CAR with optional accessory module(s)
MALPVTALLLPLALLLHAARPDVVMTQSPLSLPVTLGQPASISCRSSQSIVHSDGNTYLEWYQQRPGQSPRRLIYKVSNRFSGVPDRFSGSGSGTDFTLKISRVEAEDVGVYYCFQGSHAPWTFGGGTKVEIKGGGGSGGGGSGGGGSEVQLVESGGGLVQPGGSLRLSCAASGFTFSSYGMHWVRQAPGKGLEWVAYITTRSSTIYYADSVKGRFTISRDNAKNSLYLQMNSLRAEDTAVYYCTREPLTGYYAMDYWGQGTSVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5018 - protein, 911 aa, Artificial Sequence
  Synthetic Polypeptide encoding a CAR with optional accessory module(s)
MALPVTALLLPLALLLHAARPDIQMTQSPSSLSASVGDRVTITCRASQSISLWLNWYQQKPGKAPKLLIYAASTLQSGVPSRFSGSGSGTDFTLTISSLQPEDFATYYCQQYYTSPYTFGQGTKVEIKRGGGGSGGGGSGGGGSQVQLLESGGGLVQPGGSLRLSCAASGFTFSSYAMSWVRQAPGKGLEWVSVIRSSGSSTYYADSVKGRFTISRDNSKNTLYLQMNSLRAEDTAVYYCARGGGYFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5019 - protein, 914 aa, Artificial Sequence
  Synthetic Polypeptide encoding a CAR with optional accessory module(s)
MALPVTALLLPLALLLHAARPDIQMTQSPSSLSASVGDRVTITCRASQSISSYLNWYQQKPGKAPKLLIYAVSTLQSGVPSRFSGSGSGTDFTLTISSLQPEDFATYYCQQSGTFPPTTFGQGTKVEIKRGGGGSGGGGSGGGGSQVQLLESGGGLVQPGGSLRLSCAASGFTFSSHGMHWVRQAPGKGLEWVSVISGSGSNTGYADSVKGRFTISRDNSKNTLYLQMNSLRAEDTAVYYCARQWGSYAFDSWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5020 - protein, 924 aa, Artificial Sequence
  Synthetic Polypeptide encoding a CAR with optional accessory module(s)
MALPVTALLLPLALLLHAARPDIVMSQSPSSLAVSVGEKVTMSCKSSQSLLHSSNQKNYLAWYQQKPGQSPKVLIYWASTRESGVPDRFTGSGSGTDFTLTITSVKSEDLAVYYCQQYYSYPWTFGGGTRLEIKRGGGGSGGGGSGGGGSEVQLQQSVAELVKPGASVKMSCKVSGYTLTDHTIHWMKQRPEQGLEWIGYIYPRDGITGYNEKFKGKATLTADTSSSTAYMQLNSLTSEDSAVYFCARWGYSYRNYAYYYDYWGQGTTLTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5021 - protein, 921 aa, Artificial Sequence
  Synthetic Polypeptide encoding a CAR with optional accessory module(s)
MALPVTALLLPLALLLHAARPEIVLTQSPGTLSLSPGERATLSCRASQSVSSSYLAWYQQKPGQAPRLLIYGTSSRATGIPDRFSGSGSGTDFTLTISRLEPEDFAVYYCQQYGSSPFTFGGGTKVEIKRGGGGSGGGGSGGGGSQVQLQESGPGLAKPSETLSLTCTVSGDSITSYYWSWIRQPPGKGLEWIGYIYYSGSTNYNPSLKSRVTISVDTSKNQFSLKLSSVTAADTAVYYCARDQRRIAAAGTHFYGMDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5022 - protein, 913 aa, Artificial Sequence
  Synthetic Polypeptide encoding a CAR with optional accessory module(s)
MALPVTALLLPLALLLHAARPDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKGGGGSGGGGSGGGGSQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSATREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5023 - protein, 906 aa, Artificial Sequence
  Synthetic Polypeptide encoding a CAR with optional accessory module(s)
MALPVTALLLPLALLLHAARPMTQSPKFLLVSAGDRVTLTCKASQSVNNDVYWYQQEPGQSPKLLIYWASTRESGVPDRFTGSGSGTDFTLTISSVQAEDLAVYYCKQSYNLYTFGGGTKLEIKRGGGGSGGGGSGGGGSESGRGLVQPGGSRKLSCAASGFTFSTSGMHWVRQAPEKGLEWVAYISSGSTTIYHADTVKGRFTISRDNPKNTLFLQMTSLRSEDTAMYYCCARSGQFGNYFDYWGQGTTLTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5024 - protein, 911 aa, Artificial Sequence
  Synthetic Polypeptide encoding a CAR with optional accessory module(s)
MALPVTALLLPLALLLHAARPQSPSSLAVSAGEKVTMSCKSSQSLLNSRTRKNYLAWYQQKPGQSPKLLIYWASTRESGVPDRFTGSGSGTDFTLTISSVQAEDLAVYYCKQSNLYTFGGGTKLEIKGGGGSGGGGSGGGGSQVQLEESGPELVKPGASVKLSCKASGYTFTEYIIHWVKQRSGQGLEWIGWFYPGSGSIKYNEKFKDKATLTADKSSSTVYMELSGLTSEDSAVYFCARHDGYSYFDYWGQGTTLTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5025 - protein, 923 aa, Artificial Sequence
  Synthetic Polypeptide encoding a CAR with optional accessory module(s)
MEMFQGLLLLLLLSMGGTWASREMLRPRCRPINATLAVEKEGCPVCITVNTTICAGYCPTMTRVLQGVLPALPQVVCNYRDVRFESIRLPGCPRGVNPVVSYAVALSCQCALCRRSTTDCGGPKDHPLTCDDPRFQASSSSKAPPPSLPSPSRLPGPSDTPILPQGGGGSGGGGSGGGGSAPDVQDCPECTLQENPFFSQPGAPILQCMGCCFSRAYPTPLRSKKTMLVQKNVTSESTCCVAKSYNRVTVMGGFKVENHTACHCSTCYYHKSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5026 - protein, 914 aa, Artificial Sequence
  Synthetic Polypeptide encoding a CAR with optional accessory module(s)
MALPVTALLLPLALLLHAARPDIQMTQSPSSLSASLGERVSLTCRATQELSGYLSWLQQKPDGTIKRLIYAASTLDSGVPKRFSGNRSGSDYSLTISSLESEDFADYYCLQYAIYPYTFGGGTKLEIKGGGGSGGGGSGGGGSEVQLQQSGPELVKPGASVKMSCKASGYTFTSYFIHWVKQKPGQGLEWIGFINPYNDGSKYNEKFKGKATLTSDKSSSTAYMELSSLTSEDSAVYYCTRDDGYYGYAMDYWGQGTSVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5027 - protein, 919 aa, Artificial Sequence
  Synthetic Polypeptide encoding a CAR with optional accessory module(s)
MALPVTALLLPLALLLHAARPDTIVLTQSPASLAVSLGQRATISCRASESVDSYGNSFMHWYQQKPGQPPKLLIYLASNLESGVPARFSGSGSRTDFTLTIDPVEADDAATYYCQQNNYDPWTFGGGTKLEIKGGGGSGGGGSGGGGSEVQLQQSGPELVKPGASVKMSCKASGYTFTSYVMHWVKQKPGQGLEWIGYINPYNDGTKYNEKFKGKATLTSDTSSSTAYMELNSLTSEDSAVYFCARPIYFDNDYFDYWGQGTTLKVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5028 - protein, 914 aa, Artificial Sequence
  Synthetic Polypeptide encoding a CAR with optional accessory module(s)
MALPVTALLLPLALLLHAARPDIQMTQSPSSLSASVGDRVTITCKASQDVSTAVAWFQQKPGKAPKLLIYSPSYRYTGVPSRFSGSGSGTDFTLTISSLQPEDFTYYCQQLYSTPYTFGQGTKVEIKGGGGSGGGGSGGGGSEVQLVQSGAEVKKPGASVKVSCKASGYTFTDYYLDVVVRQAPGQGLEWIGRVNPYNGGTIYNQKFKGRVTLTRDTSTSTAYLELSSLRSEDTAVYYCARDHYRYDPLLDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5029 - protein, 920 aa, Artificial Sequence
  Synthetic Polypeptide encoding a CAR with optional accessory module(s)
MALPVTALLLPLALLLHAARPDIQMTQSPSSLSASVGDRVTITCRASQSVSTSSYNYMHWYQQKPGKPPKLLIKYASNLESGVPSRFSGSGSGTDFTLTISSLQPEDFATYYCQHSWEIPLTFGQGTKVEIKGGGGSGGGGSGGGGSEVQLVQSGAEVKKPGASVKVSCKASGYSFTDYYMHWVRQAPGQGLEWIGRINPYNGAAFYSQNFKDRVTLTVDTSTSTAYLELSSLRSEDTAVYYCAIERGADLEGYAMDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5030 - protein, 918 aa, Artificial Sequence
  Synthetic Polypeptide encoding a CAR with optional accessory module(s)
MALPVTALLLPLALLLHAARPEIVLTQSPATLSASPGERVTLTCRASSNVISSYVHWYQQKPGSSPRLFLYSTSNLASGVPSRFSGSGSGTDFTFTISSLEAEDAATYYCQQYSGYPLTFGQGTRLEIKGGGGSGGGGSGGGGSQVQLQESGPGLVKPSETLSLTCAVSGYSITSAYYWNWIRQPPGKGLEWIGYISYDGRNNYNPSLKNRITINPDTSKNQFSLQLNSVTPEDTAVYYCAREGDYDVGNYYAMDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5031 - protein, 918 aa, Artificial Sequence
  Synthetic Polypeptide encoding a CAR with optional accessory module(s)
MALPVTALLLPLALLLHAARPEIVLTQSPATLSLSPGERATLSCRASSNVISSYVHWYQQKPGQAPRLLIYSTSNLASGIPARFSGSGSGTDFTLTISSLEPEDFAVYYCQQYSGYPLTFGQGTRLEIKGGGGSGGGGSGGGGSEVQLVESGGGLVQPGRSLRLSCAASGYSITSAYYWNWVRQAPGKGLEWVSYISYDGRNNYNPSLKNRFTISRDNAKKSLYLQMNSLRAEDTALYYCAKEGDYDVGNYYAMDYWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5032 - protein, 930 aa, Artificial Sequence
  Synthetic Polypeptide encoding a CAR with optional accessory module(s)
MALPVTALLLPLALLLHAARPDLNFMLTQPHSVSGSPGKTVTISCTRSTGSITSNYVHWYQQRPGSSPTTVICEDNERPSGVPDRFSGSIDISSNSASLTISGLKTEDEADYYCQSYDDSNHISVFGTGTKVTVLGQPKANPGGGGSGGGGSGGGGSQVQLQESGPGLVKPSETLSLTCTVSGGSISSSNYYWGWIRQPPGKGLEWIGAIYYSGSTYYNPSLKSRVAISVDTSKNQFSLKLSSVTAADTAVYYCARRIGVAGQWYFDLWGRGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5033 - protein, 916 aa, Artificial Sequence
  Synthetic Polypeptide encoding a CAR with optional accessory module(s)
MALPVTALLLPLALLLHAARPDIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIKGGGGSGGGGSGGGGSQIQLVQSGPDLKKPGETVKISCKASGYTFTNTGMNWVKQAPGKGLKWMGWINTYTGEPTYADDFKGRFTFSLETSASTAYLQINNLKNEDTATYFCTRWGYGSSLYYAMDYWGQGTSVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5034 - protein, 913 aa, Artificial Sequence
  Synthetic Polypeptide encoding a CAR with optional accessory module(s)
MALPVTALLLPLALLLHAARPDIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIKGGGGSGGGGSGGGGSEVQLVESGGGLVQPGGSLRLSCAASGFDFSRYWMSWVRQAPGKGLEWIGEINPDSSTINYAPSLKDKFIISRDNAKNSLYLQMNSLRAEDTAVYYCARPDGNYWYFDVWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5035 - protein, 914 aa, Artificial Sequence
  Synthetic Polypeptide encoding a CAR with optional accessory module(s)
MALPVTALLLPLALLLHAARPDIVMTQSQKSMSTSVGDRVSITCKASQDVITGVAWYQQKPGQSPKLLIYSASYRYTGVPDRFTGSGSGTDFTFTISNVQAEDLAVYYCQQHYSTPLTFGAGTKLELKGGGGSGGGGSGGGGSQVQLQQPGAELVRPGASVKLSCKASGYSFTTYWMNWVKQRPGQGLEWIGMIHPSDSETRLNQKFKDKATLTVDKSSSTAYMQLSSPTSEDSAVYYCARSTMIATRAMDYWGQGTSVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5036 - protein, 916 aa, Artificial Sequence
  Synthetic Polypeptide encoding a CAR with optional accessory module(s)
MALPVTALLLPLALLLHAARPDIQMTQSPSSLSASVGDRVTITCKASQDVSTAVAWYQQKPGKAPKLLIYSASYRYTGVPDRFTGSGSGTDFTLTISSLQPEDFATYYCQQHYSTPPYTFGGGTKVEIKRGGGGSGGGGSGGGGSQVQLVQSGAEVKKPGASVKVSCKASGYAFSSSWMNWVRQAPGQGLEWIGRIYPGDGDTKYNGKFKGKATLTADKSTSTAYMELSSLRSEDTAVYYCARSTMIATGAMDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5037 - protein, 917 aa, Artificial Sequence
  Synthetic Polypeptide encoding a CAR with optional accessory module(s)
MALPVTALLLPLALLLHAARPDVVMTQTPLSLSVTPGQPASISCRSSQSLVHNNGNTYLHWYLQKPGQSPQLLIYKVSNRFSGVPDRFSGSGSGTDFTLKISRVEAEDVGVYFCSQSTHVPPYTFGGGTKVEIKGGGGSGGGGSGGGGSEVQLVESGGGLVQPGGSLRLSCAASGFTFSDYYMAWVRQAPGKGLEWVAEINYDGSSTYYVDSVKGRFTISRDNAKNSLYLQMNSLRAEDTAVYYCARDRGFYFDYWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5038 - protein, 917 aa, Artificial Sequence
  Synthetic Polypeptide encoding a CAR with optional accessory module(s)
MALPVTALLLPLALLLHAARPDVVMTQTPLSLSVTPGQPASISCRSSQSLVHSNGLTYLHWYLQKPGQSPQLLIYKVSNRFSGVPDRFSGSGSGTDFTLKISRVEAEDVGVYFCSQSTHVPPFTFGGGTKVEIKGGGGSGGGGSGGGGSEVQLVESGGGLVQPGGSLRLSCAASGFTFSDYYMAWVRQAPGKGLEWVASINYDGESTYYVDSVKGRFTISRDNAKNSLYLQMNSLRAEDTAVYYCARDRGYYFDYWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5039 - protein, 917 aa, Artificial Sequence
  Synthetic Polypeptide encoding a CAR with optional accessory module(s)
MALPVTALLLPLALLLHAARPDVVMTQSPLSLPVTPGEPASISCRSSQSLVHSNGNTYLHWYLQKPGQSPQLLIYKVSNRFSGVPDRFSGSGSGTDFTLKISRVEAEDVGVYFCSQSTHVPPFTFGGGTKVEIKGGGGSGGGGSGGGGSEVQLVESGGGLVQPGGSLRLSCAASGFTFSDYYMAWVRQAPGKGLEWVADINYDGGSTYYLDSLKSRFTISRDNAKNSLYLQMNSLRAEDTAVYYCARDRGYYFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5040 - protein, 915 aa, Artificial Sequence
  Synthetic Polypeptide encoding a CAR with optional accessory module(s)
MALPVTALLLPLALLLHAARPDIQMTQSSSYLSVSLGGRVTITCKASDHINNWLAWYQQKPGNAPRLLISGATSLETGVPSRFSGSGSGKDYTLSITSLQTEDVATYYCQQYWSTPWTFGGGTKLEIKGGGGSGGGGSGGGGSQVQLQQSGAELARPGASVKLSCKASGYTFTSYWMQWVKQRPGQGLEWIGAIYPGDGDTRYTQKFKGKATLTADKSSSTAYMQLSSLASEDSAVYYCARGKVYYGSNPFAYWGQGTLVTVSATREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5041 - protein, 915 aa, Artificial Sequence
  Synthetic Polypeptide encoding a CAR with optional accessory module(s)
MALPVTALLLPLALLLHAARPDIVMTQSHKFMSTSVGDRVSITCKASQDVSTAVAWYQQKPGQSPKLLIYSASYRYTGVPDRFTGSGSGTDFTFTISSVQAEDLAVYYCQQHYSTPPYTFGGGTKLEIKGGGGSGGGGSGGGGSQVQLQQSGPELVKPGASVKISCKASGYAFSSSWMNWVKQRPGQGLEWIGRIYPGDGDTKYNGKFKGKATLTADKSSSTAYMQLSSLTSVDSAVYFCARSTMIATGAMDYWGQGTSVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5042 - protein, 920 aa, Artificial Sequence
  Synthetic Polypeptide encoding a CAR with optional accessory module(s)
MALPVTALLLPLALLLHAARPQSVLTQPPSVSGAPGQRVTISCTGSGSNIGAPYDVSWYQQLPGTAPKLLIYHNNKRPSGVPDRFSGSKSGTSASLAITGLQAEDEADYYCATVEAGLSGSVFGGGTKLTVLGAGGGGSGGGGSGGGGSQVQLVQSGAEVKKPGASVKVSCKVSGYTLTELSIHWVRQAPGKGLEWMGGFDPEENEIVYAQRFQGRVTMTEDTSTDTAYMELSSLRSEDTAVYYCAIVGSFSPLTLGLWGQGTMVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5043 - protein, 920 aa, Artificial Sequence
  Synthetic Polypeptide encoding a CAR with optional accessory module(s)
MALPVTALLLPLALLLHAARPQSVLTQPPSVSGAPGQRVTISCTGSGSNIGAPYDVSWYQQLPGTAPKLLIYHNNKRPSGVPDRFSGSKSGTSASLAITGLQAEDEADYYCQSYDSSSISTIFGGGTKLTVLGAGGGGSGGGGSGGGGSQVQLVQSGAEVKKPGASVKVSCKVSGYTLTELSIHWVRQAPGKGLEWMGGFDPEENEIVYAQRFQGRVTMTEDTSTDTAYMELSSLRSEDTAVYYCAIVGSFSGIAYRPWGQGTMVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5044 - protein, 931 aa, Artificial Sequence
  Synthetic Polypeptide encoding a CAR with optional accessory module(s)
MALPVTALLLPLALLLHAARPDEFEVQLVESGGGLVQAGGSLRLSCVASGISSSKRNMGWYRQAPGKQRESVATISSGGNKDYTDAVKDRFTISRDTTKNTVYLQMNSLKPEDTAVYYCKIEAGTGWATRRGYTYWGQGTLVTVSSLEGGGGSGGGGSGGGGSFEVQLVESGGGLVQAGGSLRLSCAASGSIFSGNVMGWYRRQAPGKEREWVAAIASGGSIYYRDSVKGRFTISRDNAKNTVYLQMNSLKPEDTAVYYCNSHPPTLPYWGLGTQVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5045 - protein, 965 aa, Artificial Sequence
  Synthetic Polypeptide encoding a CAR with optional accessory module(s)
MALPVTALLLPLALLLHAARPDEFEVQLVESGGGLVQAGDSLRLSCAASGRAFSRYAMGWFRQAPGKEREFVAAIGWGPSKTNYADSVKGRFTISRDNAKNTVYLQMNTLKPEDTAVYSCAAKFVNTDSTWSRSEMYTYWGQGTLVTVSSLEGGGGSGGGGSGGGGSGSGGSGSGGSGSGGSGSGGSFEVQLVESGGGSVQAGGSLRLSCTTSGRALNMYVMGWFRQAPGNEREFVAATSSSGGSTSYPDSVKGRFTISRDNAKNTVYLQMNSLKPEDTAAYRCAASPYVSTPTMNILEEYRYWGLGTQVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5046 - protein, 918 aa, Artificial Sequence
  Synthetic Polypeptide encoding a CAR with optional accessory module(s)
MALPVTALLLPLALLLHAARPDIQMTQSPSSLSASVGDRVTITCSASSSVSYMYWYQQKPGKAPKLLIYLTSNLASGVPSRFSGSGSGTDFTLTISSLQPEDFATYYCQQWRSNPFTFGQGTKLEIKRGGGGSGGGGSGGGGSQITLKESGPTLVKPTQTLTLTCTFSGFSLSTSGMGVGWIRQPPGKALEWLAHIWWDDVKRYSPSLKSRLTITKDTSKNQVVLTMTNMDPVDTATYYCARIVSFDNDVVSAMDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5047 - protein, 913 aa, Artificial Sequence
  Synthetic Polypeptide encoding a CAR with optional accessory module(s)
MALPVTALLLPLALLLHAARPEIVMTQSPATLSVSPGERATLSCKASQSVSNDVVWYQQKPGQAPRLLIYYASNRYTGIPARFSGSGSGTEFTLTISSLQSEDFAVYYCQQDYTSPWTFGQGTKLEIKRGGGGSGGGGSGGGGSQVQLVQSGAEVKKPGASVKVSCKASGYTFTNYGMNWVRQAPGQGLEWMGWINTYTGEPTYADDFKGRVTMTTDTSTSTAYMELRSLRSDDTAVYYCARIGDSSPSDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5048 - protein, 914 aa, Artificial Sequence
  Synthetic Polypeptide encoding a CAR with optional accessory module(s)
MALPVTALLLPLALLLHAARPDSTDIQMTQSPSSLSASVGDRVTITCRASQSISSYLNWYQQKPGKAPKLLIYLASNLQSGVPSRFSGSGSGTDFTLTISSLQPEDFATYYCQQAEYMPLTFGQGTKVEIKRAGGGGSGGGGSGGGGSEVQLLESGGGLVQPGGSLRLSCAASGFTFSGYAMSWVRQAPGKGLEWVSEIAPPGLNTRYADSVKGRFTISRDNSKNTLYLQMNSLRAEDTAVYYCAKSDTAFDYWGQGTLVTVSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5049 - protein, 917 aa, Artificial Sequence
  Synthetic Polypeptide encoding a CAR with optional accessory module(s)
MALPVTALLLPLALLLHAARPDQAVLTQESALTTSPGETVTLTCRSSTGAVTTSNYANWVQEKPDHLFTGLIGGTNNRVPGVPARFSGSLIGDKAALTITGAQTEDEAIYFCVLWHSNHWVFGGGTKLTVLGGGGSGGGGSGGGGSDVQLVESGGGLVQPGGSRKLSCAASGFTFSSFGMHWVRQAPEKGLEWVAYISSGSSTLHYADTVKGRFTISRDNPKNTLFLQMTSLRSEDTAMYYCARWGNYPHYAMDYWGQGTSVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5050 - protein, 799 aa, Artificial Sequence
  Synthetic Polypeptide encoding a CAR with optional accessory module(s)
MALPVTALLLPLALLLHAARPDEFEVQLVESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5051 - protein, 941 aa, Artificial Sequence
  Synthetic Polypeptide encoding a CAR with optional accessory module(s)
MALPVTALLLPLALLLHAARPDEFEVQLVESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTLVTVSSLEGGGGSGGGGSGGGGSFEEVQLVESGGGSVQAGGSLRLSCAASGDTYGSYWMGWFRQAPGKEREGVAAINRGGGYTVYADSVKGRFTISRDTAKNTVYLQMNSLRPDDTADYYCAASGVLGGLHEDWFNYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5052 - protein, 960 aa, Artificial Sequence
  Synthetic Polypeptide encoding a CAR with optional accessory module(s)
MALPVTALLLPLALLLHAARPDEFEVQLVESGGGSVQAGGSLRLTCAASGSTSRSYGMGWFRQAPGKEREFVSGISWRGDSTGYADSVKGRFTISRDNAKNTVDLQMNSLKPEDTAIYYCAAAAGSTWYGTLYEYDYWGQGTLVTVSSLEGGGGSGGGGSGGGGSGSGGSGSGGSGSGGSGSGGSFEVQLVESGGGSVQAGGSLRLSCAASGDTYGSYWMGWFRQAPGQEREAVAAINRGGGYTVYADSVKGRFTISRDNAKNTLYLQMNSLRPDDTADYYCAASGVLGGLHEDWFNYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5053 - protein, 908 aa, Artificial Sequence
  Synthetic Polypeptide encoding a CAR with optional accessory module(s)
MALPVTALLLPLALLLHAARPDIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVEGGGGSGGGGSGGGGSEVQVLESGGGLVQPGGSLRLSCAASGFTFSSYAMSWVRQAPGKGLEWVSAISGSGGSTNYADSVKGRFTISRDNSKNTLYLQMNSLRAEDTAVYYCAGSSGWSEYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5054 - protein, 914 aa, Artificial Sequence
  Synthetic Polypeptide encoding a CAR with optional accessory module(s)
MALPVTALLLPLALLLHAARPDEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSGGGGSGGGGSGGGGSDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5055 - protein, 921 aa, Artificial Sequence
  Synthetic Polypeptide encoding a CAR with optional accessory module(s)
MALPVTALLLPLALLLHAARPDELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGGGGSGGGGSGGGGSEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5056 - protein, 922 aa, Artificial Sequence
  Synthetic Polypeptide encoding a CAR with optional accessory module(s)
MALPVTALLLPLALLLHAARPDELQMTQSPSSLSASVGDRVTITCRASQSISSYLNWYQQKPGQPPKLLIYWASTRESGVPDRFSGSESGTNYTLTISSLQPEDFATYFCQQSDSLPITFGQGTRLDIQGGGGSGGGGSGGGGSEVQLLESGGGVVQPGRSLRLSCAASGFTFSSYGMHWVRQAPGKGLEWVAVISYDGSNKYYADSVKGRFTISRDNSKNTLYLQMNSLRAEDTAVYYCAKDMGWGSGWRPYYYYGMDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5057 - protein, 919 aa, Artificial Sequence
  Synthetic Polypeptide encoding a CAR with optional accessory module(s)
MALPVTALLLPLALLLHAARPDDIQMTQSPSSLSASVGDRVTITCRASQSISSYLNWYQQKPGKAPKLLIYAASSLQSGVPSRFSGSGSGTDFTLTISSLQPEDLATYYCQQSYSTPFTFGPGTKVDIKGGGGSGGGGSGGGGSVHEVQLVQSGAEVKKPGSSVKVSCKASGGTFSSYAISWVRQAPGQGLEWMGGIIPIFGTANYAQKFQGRVTITADKSTSTAYMELSSLRSEDTAVYYCATFALFGFREQAFDIWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5058 - protein, 916 aa, Artificial Sequence
  Synthetic Polypeptide encoding a CAR with optional accessory module(s)
MALPVTALLLPLALLLHAARPDVVMTQTPLSLPVSLGDQASISCRSSQSLVHSNGNTYLRWYLQKPGQSPKVLIYKVSNRFSGVPDRFSGSGSGTDFTLKISRVEAEDLGVYFCSQSTHVPWTFGGGTKLEIKGGGGSGGGGSGGGGSEVKLDETGGGLVQPGRPMKLSCVASGFTFSDYWMNWVRQSPEKGLEWVAQIRNKPYNYETYYSDSVKGRFTISRDDSKSSVYLQMNNLRVEDMGIYYCTGSYYGMDYWGQGTSVTVSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5059 - protein, 927 aa, Artificial Sequence
  Synthetic Polypeptide encoding a CAR with optional accessory module(s)
MALPVTALLLPLALLLHAARPDVVMTQTPLSLPVSLGDQASISCRSSQSLVHSNGNTYLRWYLQKPGQSPKVLIYKVSNRVSGVPDRFSGSGSGTDFTLKINRVEAEDLGVYFCSQSTHVPWTFGGGTKLEIKSSADDAKKDAAKKDDAKKDDAKKDGGVKLDETGGGLVQPGGAMKLSCVTSGFTFGHYWMNWVRQSPEKGLEWVAQFRNKPYNYETYYSDSVKGRFTISRDDSKSSVYLQMNNLRVEDTGIYYCTGASYGMEYLGQGTSVTVSTTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5060 - protein, 923 aa, Artificial Sequence
  Synthetic Polypeptide encoding a CAR with optional accessory module(s)
MALPVTALLLPLALLLHAARPQVQLVESGGNLVQPGGSLRLSCAASGFTFGSFSMSWVRQAPGGGLEWVAGLSARSSLTHYADSVKGRFTISRDNAKNSVYLQMNSLRVEDTAVYYCARRSYDSSGYWGHFYSYMDVWGQGTLVTVSGGGGSGGGGSGGGGSSVLTQPSSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLGTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5061 - protein, 918 aa, Artificial Sequence
  Synthetic Polypeptide encoding a CAR with optional accessory module(s)
MALPVTALLLPLALLLHAARPDIQMTQSPSSLSASVGDRVTITCRTSQSLSSYTHWYQQKPGKAPKLLIYAASSRGSGVPSRFSGSGSGTDFTLTISSLQPEDFATYYCQQSRTFGQGTKVEIKGGGGSGGGGSGGGGSQVQLQQSGPGLVKPSQTLSLTCAISGDSVSSYNAVWNWIRQSPSRGLEWLGRTYYRSGWYNDYAESVKSRITINPDTSKNQFSLQLNSVTPEDTAVYYCARSGHITVFGVNVDAFDMWGQGTMVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5062 - protein, 917 aa, Artificial Sequence
  Synthetic Polypeptide encoding a CAR with optional accessory module(s)
MALPVTALLLPLALLLHAARPDIVLTQSPLSLAVSLGQPAIISCKASQSVSFAGTSLMHWYHQKPGQQPRLLIYRASNLEAGVPDRFSGSGSKTDFTLTISPVEAEDAATYYCQQSREYPYTFGGGTKLEIKRGGGGSGGGGSGGGGSQVQLVQSGAEVVKPGASVKISCKASGYTFTGYFMNWVKQSPGQSLEWIGRIHPYDGDTFYNQKFQGKATLTVDKSSNTAHMELLSLTSEDFAVYYCTRYDGSRAMDYWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5063 - protein, 890 aa, Artificial Sequence
  Synthetic Polypeptide encoding a CAR with optional accessory module(s)
MALPVTALLLPLALLLHAARPNSCELTNITIAIEKEECRFCISINTTWCAGYCYTRDLVYKDPARPKIQKTCTFKELVYETVRVPGCAHHADSLYTYPVATQCHCGKCDSDSTDCTVRGLGPSYCSFGEMKEGGGGSGGGGSGGGGSAPDVQDCPECTLQENPFFSQPGAPILQCMGCCFSRAYPTPLRSKKTMLVQKNVTSESTCCVAKSYNRVTVMGGFKVENHTACHCSTCYYHKSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5064 - protein, 921 aa, Artificial Sequence
  Synthetic Polypeptide encoding a CAR with optional accessory module(s)
MALPVTALLLPLALLLHAARPDLETTLTQSPATLSVSPGERVTLSCRASQSVGSNLAWYQQKFGQAPRLLIYDASTRATGIPARFSGSGSGTEFTLTISRLEPEDFAVYYCHQYGSSPRTFGQGTKVDIKRGGGGSGGGGSGGGGSQVQLVQSGAEVKKPGASVKVSCKASGYTFTTYGISWVRQAPGQGLEWMGWISAYNGHTNYAQMLQGRVTMTTDTSTSTAYMELRGLRSDDTAVYYCAREAYASYGSGSYWTDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5065 - protein, 914 aa, Artificial Sequence
  Synthetic Polypeptide encoding a CAR with optional accessory module(s)
MALPVTALLLPLALLLHAARPDDVVMTQTPLSLPVTPGEPASISCRSSQSLVHRNGNTYLHWYLQKPGQSPKLLIHKVSNRFSGVPDRFSGSGSGTDFTLKISRVEAEDLGVYFCSQSTHVPPLTFGAGTKLELKGGGGSGGGGSGGGGSEVQLVQSGAEVEKPGASVKISCKASGSSFTGYNMNWVRQNIGKSLEWIGAIDPYYGGTSYNQKFKGRATLTVDKSTSTAYMHLKSLRSEDTAVYYCVSGMEYWGQGTSVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5066 - protein, 912 aa, Artificial Sequence
  Synthetic Polypeptide encoding a CAR with optional accessory module(s)
MALPVTALLLPLALLLHAARPDEIVMTQTPATLSVSAGERVTITCKASQSVSNDVTWYQQKPGQAPRLLIYSASNRYSGVPARFSGSGYGTEFTFTISSVQSEDFAVYFCQQDYSSFGQGTKLEIKRGGGGSGGGGSGGGGSQVQLVESGPGVVQPGRSLRISCAVSGFSVTNYGVHWVRQPPGKGLEWLGVIWAGGITNYNSAFMSRLTISKDNSKNTVYLQMNSLRAEDTAMYYCASRGGHYGYALDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5067 - protein, 914 aa, Artificial Sequence
  Synthetic Polypeptide encoding a CAR with optional accessory module(s)
MALPVTALLLPLALLLHAARPDIQMTQTASSLPASLGDRVTISCSASQDISNYLNWYQQKPDGTVKLLIFYSSNLHSGVPSRFSGGGSGTDYSLTISNLEPEDIATYFCHQYSKLPWTFGGGTKLEIKRGGGGSGGGGSGGGGSEVTLVESGGDFVKPGGSLKVSCAASGFAFSHYAMSWVRQTPAKRLEWVAYISSGGSGTYYSDSVKGRFTISRDNAKNTLYLQMRSLRSEDSAMYFCTRVKLGTYYFDSWGQGTTLTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5068 - protein, 916 aa, Artificial Sequence
  Synthetic Polypeptide encoding a CAR with optional accessory module(s)
MALPVTALLLPLALLLHAARPQFVLTQSPSASAALGASAKLTCTLSSAHKTYTIDWYQQQKGKAPRYLIQVKSDGTYTKATGVPDRFSGSSSGADRYLIIPSVQADDEADYYCGTDYTGGYVFGGGTQLTVTGGGGSGGGGSGGGGSEQLKESGGGLFKPTDTLTLTCTVSGFSLSYYGVNWVRQAPGNGLEWIGTIGGSGDTYYASWAKSRSTIIRNTNENTVTLKMTSLTAADTATYFCVRYANIGYEYFNVWGPGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5069 - protein, 921 aa, Artificial Sequence
  Synthetic Polypeptide encoding a CAR with optional accessory module(s)
MALPVTALLLPLALLLHAARPQFVLTQSPSVSAALGASAKLTCTLSSAHKTYTIDWYQQQQGEAPRYLMQVKSDGSYTKGTGVPDRFSGSSSGADRYLIIPSVQADDEAGYVCGADDNGGYVFGGGTQLTVTGGGGSGGGGSGGGGSQSVKESEGGLFKPTDTLTLTCTVSGFSLSRHALTWVRQAPGNGLEWIGAIDNAGTTYYASWAKSRSTITRNTDLHTVTLKMTSLTASDTATYFCARVFYDINSGYYLDGMDLWGPGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5070 - protein, 915 aa, Artificial Sequence
  Synthetic Polypeptide encoding a CAR with optional accessory module(s)
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKGGGGSGGGGSGGGGSEVQLVESGGGLVQPGESLRLSCVASGFTFSRYKMNWVRQAPGKGLEWVSYISRSGRDIYYADSVKGRFTISRDNAKNSLYLQMNSLRDEDTAVYYCAGTVTTYYYFGMDVWGHGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5071 - protein, 916 aa, Artificial Sequence
  Synthetic Polypeptide encoding a CAR with optional accessory module(s)
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKGGGGSGGGGSGGGGSEVQLVESGGGSVQPGESLRLSCVASGFTFSRYKMNWVRQAPGKGLEWVSYISRSGRDIYYADSVKGRFTISRDNAKNSLYLQMNSLRDEDTAVYYCAGTVTTYYYDFGMDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5072 - protein, 915 aa, Artificial Sequence
  Synthetic Polypeptide encoding a CAR with optional accessory module(s)
MALPVTALLLPLALLLHAARPQSVLTQPPSASGTPGQRVTISCSGSRSNVGGNYVFWYQQVPGATPKLLIYRSNQRPSGVPDRFAGSKSGSSASLAISGLRSEDEADYYCATWDDSLSGFVFGTGTKVTVLGGGGGSGGGGSGGGGSEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARGYGKAYDQWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5073 - protein, 914 aa, Artificial Sequence
  Synthetic Polypeptide encoding a CAR with optional accessory module(s)
MALPVTALLLPLALLLHAARPQSVVTQPPSMSAAPGQQVTISCSGGNSNIERNYVSWYLQLPGTAPKLVIFDNDRRPSGIPDRFSGSKSGTSATLGITGLQTGDEADYYCGTWDSSLRGWVFGGGTKLTVLGGGGGSGGGGSGGGGSEVQLVESGGGLIQPGGSLRLSCAASGFTFSNYAMNWVRQAPGKGLEWVSTINGRGSSTIYADSVKGRFTISRDNSKNTLYLQMNSLRAEDTATYYCARYISRGLGDSWGQGTLVTVTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5074 - protein, 914 aa, Artificial Sequence
  Synthetic Polypeptide encoding a CAR with optional accessory module(s)
MALPVTALLLPLALLLHAARPQSVVTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSYVFGTGTKLTVLGGGGGSGGGGSGGGGSEVQLVETGGNLVQPGASLRLSCAASGFSFSGTAMHWVRQAPGKGLEWVSTISSTGRSTYYRDSVKGRFTISRDNSKNTLYLQMNSLRGEDTAVYYCARVSFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5075 - protein, 916 aa, Artificial Sequence
  Synthetic Polypeptide encoding a CAR with optional accessory module(s)
MALPVTALLLPLALLLHAARPQSVVTQPASVSGSPGQSITISCTGTSSDVGGYNYVSWYQQHPGKAPKLMIYDVSKRPSGVSNRFSGSKSGNTASLTISGLQAEDEADYYCSSYTSSSTLVFGGGTKLTVLGGGGGSGGGGSGGGGSEVQLVESGGAFVQPGGSLRLSCAASGFTFSSYAMTWVRQAPGKGLEWVSTISGRGRSTFYADSVKGRFTISRDNSKNTLYLQMNSLRAEDTAVYYCARYYHAGAFDLWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5076 - protein, 914 aa, Artificial Sequence
  Synthetic Polypeptide encoding a CAR with optional accessory module(s)
MALPVTALLLPLALLLHAARPDNIELTQSPAIMSASPGERVTMTCSASSSIRYIYWYQQKPGSSPRLLIYDTSNVAPGVPFRFSGSGSGTSYSLTINRMEAEDAATYYCQEWSGYPYTFGGGTKLDIKRGGGGSGGGGSGGGGSQVKLQESGGGLVKPGGSLKLSCAASGFTFSSYGMSWVRQTPDKRLEWVATISSGGSYTYYPDSVKGRFTISRDNAKNTLYLQMSSLKSEDTAMYYCARGNWEGWYFDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5077 - protein, 924 aa, Artificial Sequence
  Synthetic Polypeptide encoding a CAR with optional accessory module(s)
MALPVTALLLPLALLLHAARPDNFMLTQPHSVSESPGKTVTISCTGSGGSIDNNYVHWYQQRPGSAPTTVMFEDNQRPSGVPDRFSGSIDSSSNSASLVISGLKTEDEGDYYCQSSDGSKVVFGGGTKLTVLGQGGGGSGGGGSGGGGSEVQLVQSGGGSLTLSCAASGVVQPGRFTFSSYGMHWVRQAPGKGLEWVSVISYDGSNKYYADSVKGRFTISRDNSKNTLYLQMNSLRTEDTAVYYCAKTLSAGEWIGGGAFDIWGHGTMVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5078 - protein, 914 aa, Artificial Sequence
  Synthetic Polypeptide encoding a CAR with optional accessory module(s)
MALPVTALLLPLALLLHAARPDVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQNTPVPPKFGSGTKLEIKGGGGSGGGGSGGGGSQVQLQQSGAELVRPGASVKLSCKASGYTFNDYEMHWVKQTPVHGLKWIGALEPKTGDTAYSQKFKGKATLTADKSSSTAYMELRSLTSEDSAVYYCTSCYYYTYSGQGTLVTVSATREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5079 - protein, 913 aa, Artificial Sequence
  Synthetic Polypeptide encoding a CAR with optional accessory module(s)
MALPVTALLLPLALLLHAARPDIQLTQSPSSLSASVGDRVTITCRASQGIRNDLGWYQQKPGKAPKRLIYAASSLQNGVPSRFSGSGSGTEFTLTISSLQPEDFATYYCLQHNTYPAFGQGTKVEIKRGGGGSGGGGSGGGGSQVQLQESGPGLVKPSQTLSLTCTVSGGSISSFNYYWSWIRHHPGKGLEWIGYIYYSGSTYSNPSLKSRVTISVDTSKNQFSLTLSSVTAADTAVYYCARGYNWNYFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5080 - protein, 915 aa, Artificial Sequence
  Synthetic Polypeptide encoding a CAR with optional accessory module(s)
MALPVTALLLPLALLLHAARPDDIVLTQSPASLAVSLGQSVTISCRASESVEYYGTSLMQWYQQKPGQPPKLLIYATSNVESGVPARFSGSGSGTDFSLNIHPVEEDDIAMYFCQQSRKLPSTFGGGTKLEIKGGGGSGGGGSGGGGSDVRLQESGPGQVKPSQTVSLTCSVTGYSITNGNHWWNWIRQVSGSKLEWIGYISSSGSTDSNPSLKSRISITRDTSKNQLFLQLNSVTTEDIATYYCARGYYFDYWGQGTTLTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5081 - protein, 793 aa, Artificial Sequence
  Synthetic Polypeptide encoding a CAR with optional accessory module(s)
MALPVTALLLPLALLLHAARPDEFEVQLVESGGGLVQAGGSLRLSCAASGITFSINTMGWYRQAPGKQRELVALISSIGDTYYADSVKGRFTISRDNAKNTVYLQMNSLKPEDTAVYYCKRFRTAAQGTDYWGQGTQVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5082 - protein, 728 aa, Artificial Sequence
  Synthetic Polypeptide encoding a CAR with optional accessory module(s)
MDWIWRILFLVGAATGAHSFEGSGFEYAKEMRNAYWEIALLPNLTNQQKRAPIRKLYDDPSQSSELLSEAKKLNDSQTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5083 - protein, 799 aa, Artificial Sequence
  Synthetic Polypeptide encoding a CAR with optional accessory module(s)
MALPVTALLLPLALLLHAARPDEFGSDLGIKLLFAAAKGQDDEVRILLAAGADVNAKDFEGYTPLHVAAYDGHLEIVEVLLKAGADVNAKDSQGRTPLHEAAYSGHLEIVEVLLKAGADVNAQDDAGETPADLAAAWGHEDIAEVLQKTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5084 - protein, 798 aa, Artificial Sequence
  Synthetic Polypeptide encoding a CAR with optional accessory module(s)
MDWIWRILFLVGAATGAHSFERSDLGKKLLEAARAGQDDEVRILMANGADVNAKDEYGLTPLYLATAHGHLEIVEVLLKNGADVNAVDAIGFTPLHLAAFIGHLEIAEVLLKHGADVNAQDKFGKTAFDISIGNGNEDLAEILQKLNTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5085 - protein, 950 aa, Artificial Sequence
  Synthetic Polypeptide encoding a CAR with optional accessory module(s)
MALPVTALLLPLALLLHAARPDEFEVQLVESGGGLVQAGGSLRLSCAASGITFSINTMGWYRQAPGKQRELVALISSIGDTYYADSVKGRFTISRDNAKNTVYLQMNSLKPEDTAVYYCKRFRTAAQGTDYWGQGTQVTVSSLEGGGGSGGGGSGGGGSGSGGSGSGGSGSGGSGSGGSFEVQLVESGGGLVQPGGSLRLSCAASGSIFGFNDMAWYRQAPGKQRELVALISRVGVTSSADSVKGRFTISRVNAKDTVYLQMNSLKPEDTAVYYCYMDQRLDGSTLAYWGQGTQVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5086 - protein, 914 aa, Artificial Sequence
  Synthetic Polypeptide encoding a CAR with optional accessory module(s)
MALPVTALLLPLALLLHAARPDIQMTQSPSSLSASVGDRVTITCRASQDVNTAVAWYQQKPGKAPKLLIYSASFLESGVPSRFSGSRSGTDFTLTISSLQPEDFATYYCQQHYTTPPTFGQTKVEIKRGGGGSGGGGSGGGGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDVWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5087 - protein, 793 aa, Artificial Sequence
  Synthetic Polypeptide encoding a CAR with optional accessory module(s)
MALPVTALLLPLALLLHAARPDEFDVQLVESGGGLVQPGGSLRLSCAASGSIGGLNAMAWYRQAPGKERELVAGIFGVGSTRYADSVKGRFTISRDNSKNTVYLQMNSLRPEDTAVYYCRMSSVTRGSSDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5088 - protein, 733 aa, Artificial Sequence
  Synthetic Polypeptide encoding a CAR with optional accessory module(s)
MALPVTALLLPLALLLHAARPDEFVDNKFNKERYSAYYEIWQLPNLNVRQKAAFIGSLQDDPSQSANLLAEAKKLNDAQAPKTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5089 - protein, 955 aa, Artificial Sequence
  Synthetic Polypeptide encoding a CAR with optional accessory module(s)
MALPVTALLLPLALLLHAARPDEFDVQLVESGGGLVQPGGSLRLSCAASGSIGGLNAMAWYRQAPGKERELVAGIFGVGSTRYADSVKGRFTISRDNSKNTVYLQMNSLRPEDTAVYYCRMSSVTRGSSDYWGQGTLVTVSSLEGGGGSGGGGSGGGGSGSGGSGSGGSGSGGSGSGGSFEVQLVESGGSLVQPGGSLRLSCAASGFTFDDYAMSWVRQVPGKGLEWVSSINWSGTHTDYADSVKGRFTISRNNANNTLYLQMNSLKSEDTAVYYCAKNWRDAGTTWFEKSGSAGQGTQVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5090 - protein, 913 aa, Artificial Sequence
  Synthetic Polypeptide encoding a CAR with optional accessory module(s)
MALPVTALLLPLALLLHAARPDQSVLTQPPSVSVAPGKTARIPCEGNYIGSSNVHWYQQKPGQAPVLVIHFDSDRPSGIPDRFSGSNSGNMATLTISRVEAGDEADYYCQVWENHGWVFGGGTKLTVLSGGGGSGGGGSGGGGSEVQLVETGGGLVQPGESLRLSCAASGFTFSDYEMNWVRQAPGKGLEWVSYISSSGSTIYYADSVKGRFTIYRDNAKNSLYLQMNSLRAEDTALYYCARAWGVGPPDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5091 - protein, 921 aa, Artificial Sequence
  Synthetic Polypeptide encoding a CAR with optional accessory module(s)
MALPVTALLLPLALLLHAARPDIQMTQSPSSLSASVGDTVTITCQANGYLNWYQQRRGKAPKLLIYDGSKLERGVPSRFSGRRWGQEYNLTINNLQPEDIATYFCQVYEFVVPGTRLDLKRTVAAPGGGGSGGGGSGGGGSQVQLLQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTQVTVSSASTKGPTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5092 - protein, 927 aa, Artificial Sequence
  Synthetic Polypeptide encoding a CAR with optional accessory module(s)
MALPVTALLLPLALLLHAARPQSALTQPPSASGSPGQSITISCTGTSNNFVSWYQQHAGKAPKLVIYDVNKRPSGVPDRFSGSKSGNTASLTVSGLQTDDEAVYYCGSLVGNWDVIFGGGTKLTVLGGGGSGGGGSGGGGSQPQLQESGPTLVEASETLSLTCAVSGDSTAACNSFWGWVRQPPGKGLEWVGSLSHCASYWNRGWTYHNPSLKSRLTLALDTPKNLVFLKLNSVTAADTATYYCARFGGEVLRYTDWPKPAWVDLWGRGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5093 - protein, 912 aa, Artificial Sequence
  Synthetic Polypeptide encoding a CAR with optional accessory module(s)
MALPVTALLLPLALLLHAARPEIVLTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIKRGGGGSGGGGSGGGGSQVQLVQSGGQMKKPGESMRISCRASGYEFIDCTLNWIRLAPGKRPEWMGWLKPRGGAVNYARPLQGRVTMTRDVYSDTAFLELRSLTVDDTAVYFCTRGKNCDYNWDFEHWGRGTPVIVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5094 - protein, 922 aa, Artificial Sequence
  Synthetic Polypeptide encoding a CAR with optional accessory module(s)
MALPVTALLLPLALLLHAARPELVLTQSPGTLSLSAGERATLSCRASQSVSSGSLAWYQQKPGQAPRLLIYGASTRATGIPDRFSGSGSGTDFTLTIGRLEPEDLAVYYCQQYGTSPYTFGQGTKLEIGGGGSGGGGSGGGGSLEQSGAEVKKPGSSVQVSCKASGGTFSMYGFNWVRQAPGHGLEWMGGIIPIFGTSNYAQKFRGRVTFTADQATSTAYMELTNLRSDDTAVYYCARDFGPDWEDGDSYDGSGRGFFDFWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5095 - protein, 918 aa, Artificial Sequence
  Synthetic Polypeptide encoding a CAR with optional accessory module(s)
MALPVTALLLPLALLLHAARPDVVMTQSPSSLSASVGDRVTITCQSSLDISHYLNWYQQKPGKAPKLLIYDASNLETGVPSRFSGSGSGTHFTFTISSLQPEDFATYYCQQYDNLPLTFGGGTKLEIKRGGGGSGGGGSGGGGSQVQLVQSGGGVVQPGGSLRVSCAASGVTLSDYGMHWVRQAPGKGLEWVAFIRNDGSDKYYADSVKGRFTISRDNSEKTVSLQMSSLRAEDTAVYYCAKNGESGPLDYWYLDLWGRGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5096 - protein, 918 aa, Artificial Sequence
  Synthetic Polypeptide encoding a CAR with optional accessory module(s)
MALPVTALLLPLALLLHAARPDDIVMTQSQDSMATSVGERVTVNCKASQNVDTNVAWYQQKPGQSPEPLLFSASYRYTGVPDRFSGSGSGTDFTLTISSVQAEDVAEYFCQQYNSYPLTFGQGTKLEIKRGGGGSGGGGSGGGGSEVQVEVSGGGLVQPGGSMRLSCAVSGFTFSNYWMNWVRQSPEKGLEWIAEIRLKSNNFARYYAESVKGRFTISRDNSKNSLYLQMISLRAEDTAIYYCTSYGNYVGHYFDHWGQGTLLTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5097 - protein, 922 aa, Artificial Sequence
  Synthetic Polypeptide encoding a CAR with optional accessory module(s)
MALPVTALLLPLALLLHAARPSYELTQPPSVSGTPGQRVAISCSGSSSNIGTRMVTWYQHVPGTAPKLLIFNNNQRPSGVPDRFSASKSGTSASLAIIGLQSDDEADYYCATWDDNVKSYVFGTGTKVTVLGSRGGGGSGGGGSGGGGSLEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARAPQSWYVGDVWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5098 - protein, 919 aa, Artificial Sequence
  Synthetic Polypeptide encoding a CAR with optional accessory module(s)
MALPVTALLLPLALLLHAARPQSVLTQPPSLSVAPGKTASITCGGNNIGMKSVHWYQQRPGQAPVLVIYYDSDRPSGIPGRFSGSNSGNTATLTISRVEAGDEADYYCQVWDTTGDHPGYVFGTGTKVTVLGGGGSGGGGSGGGGSQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGVYGYSGSAPYDEWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5099 - protein, 925 aa, Artificial Sequence
  Synthetic Polypeptide encoding a CAR with optional accessory module(s)
MALPVTALLLPLALLLHAARPDEIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPRTFGQGTKVEIKRGGGGSGGGGSGGGGSQVQLVQSGGGVVQPGRSLRLSCAASGFTFSSYGMHWVRQAPGKGLEWVAVISYDGSNKYYADSVKGRFTISRDNSKNTLYLQMNSLRAEDTAVYYCARDFDYGDSYYYYGMDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5100 - protein, 919 aa, Artificial Sequence
  Synthetic Polypeptide encoding a CAR with optional accessory module(s)
MALPVTALLLPLALLLHAARPDEIVLTQSPATLSLSPGERATLSCRASQSVGSYLAWYQQKPGAPRLLIYDASHRATGIPARFSGSGSGTDFTLTISSLEPEDFAVYYCQQRSNWPPMYTFGQGTKLEIKRGGGGSGGGGSGGGGSEVQLVQSGAEVSVKVSCKASGGKKPGSTFSSYTISWVRQAPGQGLEWMGGIIPIFGTANYAQKFQGRVTITADKSTSTAYMELSSLRSEDTAVYYCAGDTDSSGYYGAVDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5101 - protein, 902 aa, Artificial Sequence
  Synthetic Polypeptide encoding a CAR with optional accessory module(s)
MALPVTALLLPLALLLHAARPDIQMTQSPSSLSASVGDRVTITCQASQDINNYLNWYQQKPGKAPKLLIYDASNLQTGVPSRFSGSGSGTDFTFTIEDIATYYCQQYTFGPGTKVDIKGGGGSGGGGSGGGGSEVQLLESGGGLVQPGGSLRLSCAASGFTFSWYSMTWVRQAPGKGLEWVSSIVPWGDFTQYADSVKGRFTISRDNSKNTLYLQMNSLRAEDTAVYYCAKGPGWGSFDLWGRGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5102 - protein, 791 aa, Artificial Sequence
  Synthetic Polypeptide encoding a CAR with optional accessory module(s)
MDWIWRILFLVGAATGAHSEVQLVESGGGLVQPGGSLRLSCAASGSVFKINVMAWYRQAPGKGRELVAGIISGGSTSYADSVKGRFTISRDNAKNTLYLQMNSLRPEDTAVYYCAFITTESDYDLGRRYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5103 - protein, 912 aa, Artificial Sequence
  Synthetic Polypeptide encoding a CAR with optional accessory module(s)
MALPVTALLLPLALLLHAARPDIQMTQSPSSLSASVGDRVTITCTASLSVSSTYLHWYQQKPGSSPKLWIYSTSNLASGVPSRFSGSGSGTSYTLTISSLQPEDFATYYCHQYHRSPLTFGGGTKVEIKRGGGGSGGGGSGGGGSEVQLVESGGGLVQPGGSLRLSCAASGFSLTKYGVHWVRQAPGKGLEWVGVKWAGGSTDYNSALMSRFTISKDNAKNSLYLQMNSLRAEDTAVYYCARDHRDAMDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5104 - protein, 916 aa, Artificial Sequence
  Synthetic Polypeptide encoding a CAR with optional accessory module(s)
MALPVTALLLPLALLLHAARPDIQMTQSPSSLSASVGDRVTITCKASQDVGTAVAWYQQKPGKAPKLLIYSASYRSTGVPSRFSGSGSGTDFTLTISSLQPEDFATYYCQHHYSAPWTFGGGTKVEIKGGGGSGGGGSGGGGSEVQLVESGGGLVQPGGSLRLSCAASGFTFSRNGMSWVRQAPGKGLEWVATVSSGGSYIYYADSVKGRFTISRDNAKNSLYLQMNSLRAEDTAVYYCARQGTTALATRFFDVWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5105 - protein, 922 aa, Artificial Sequence
  Synthetic Polypeptide encoding a CAR with optional accessory module(s)
MALPVTALLLPLALLLHAARPDIVMTQSPSSLTMSVGQKVTMSCKSSHSLLNSRNQKNYLAWFQQKPGQSPKLLVYFASTRESGVPDRFIGSGSGTDFTLTISNVQAEDLADYFCQQHYTTLPTFGGGTKLEIKGGGGSGGGGSGGGGSQIQLVQSGPDLKKPGETVKISCKASGYTFTNTGMNWVKQAPGKGLKWMGWINTYTGEPTYADDFKGRFTFSLETSASTAYLQINNLKNEDTATYFCTRWGYGSSLYYAMDYWGQGTSVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5106 - protein, 912 aa, Artificial Sequence
  Synthetic Polypeptide encoding a CAR with optional accessory module(s)
MALPVTALLLPLALLLHAARPDIQMTQSPPSLSASVGGKVTITCKASQDIDRYMAWYQDKPGKGPKLLIHDTSTLQPGIPSRFSGSGSGRDYSFSISNLEPEDIATYYCLQYDNLWTFGGGTKLEIKRGGGGSGGGGSGGGGSQVQLVQSGAELVKPGASVKMSCKASGYIFTNYNIHWVKKSPGQGLEWIGAIYPGNGDAPYSQKFQDRATLTADTSSSTTYMELSSLTSEDSAVYYCVRANWDVAFAYWGQGTLVSVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5107 - protein, 913 aa, Artificial Sequence
  Synthetic Polypeptide encoding a CAR with optional accessory module(s)
MALPVTALLLPLALLLHAARPDIQMTQSPASLSASVGETVTITCRVSGNIHNYLAWYQQKQGKSPQLLVYNAKTLADGVPSRFSGSGSGTQYSLKINSLQPEDFGSYYCQHFWSNPYTFGGGTKLEIKGGGGSGGGGSGGGGSQVQLQQSGASVKVSCKASELVRPGTGYAFTNYLIEWVKQRPGQGLEWIGVINPGSGGTNYNEKFKGKATLTADKSSSTAYMQLSSLTSDDSAVYFCARYRSYDWYFDVWGAGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5108 - protein, 918 aa, Artificial Sequence
  Synthetic Polypeptide encoding a CAR with optional accessory module(s)
MALPVTALLLPLALLLHAARPDDIQMTQSPSSLSASVGDRVTITCRSSQRIVHSNGNTYLEWYQQTPGKAPKLLIYKVSNRFSGVPSRFSGSGSGTDYTPTISSLQPEDIATYYCFQGSHVPPTFGQGTKLQITGGGGSGGGGSGGGGSEVQLVESGGGVVQPGRSLRLSCSSSGPTFSDYYMYWVRQAPGKGLEWVAYMSNVGAITDYPDTVKGRPTISRDNSKNTLFLMDSLRPEDTGVYFCARGTRDGSWFAYWGQGTPVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5109 - protein, 912 aa, Artificial Sequence
  Synthetic Polypeptide encoding a CAR with optional accessory module(s)
MALPVTALLLPLALLLHAARPDIQMTQSFSSLSASVGDRVTITCRASQDISNYLNWYQQKPGKAPKLLIYYTSRLHSGVPSRFSGSGSGTDYTLTISSLQPEDFATYFCQQGNTLPWTFGGGTKLEIKRGGGGSGGGGSGGGGSEVQLVQSGGGLVQSGGSLRLSCRASGYTFTRYWMLWVRQRPGKGLEWVAEINPRNDRTNYNEKFKTRFTISVDRSKNTLYLQMDSLRAEDTAVYFCALGGGYAMDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5110 - protein, 899 aa, Artificial Sequence
  Synthetic Polypeptide encoding a CAR with optional accessory module(s)
MEMLQGLLLLLLLSMGGAWASREPLRPWCHPINAILAVEKEGCPVCITVNTTICAGYCPTMMRVLQAVLPPLPQVVCTYRDVRFESIRLPGCPRGVDPVVSFPVALSCRCGPCRRSTSDCGGPKDHPLTCDHPQLSGLLFLGGGGSGGGGSGGGGSAPDVQDCPECTLQENPFFSQPGAPILQCMGCCFSRAYPTPLRSKKTMLVQKNVTSESTCCVAKSYNRVTVMGGFKVENHTACHCSTCYYHKSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5111 - protein, 913 aa, Artificial Sequence
  Synthetic Polypeptide encoding a CAR with optional accessory module(s)
MALPVTALLLPLALLLHAARPDIQMTQSPASLSASVGETVTIICRASVNIYSYLAWYQQKQGKSPQLLVYNAKILAEGVPSRFSGSGSGTQFSLKINSLQPEDFGSYYCQHHYGTFTFGSGTKLEIKRGGGGSGGGGSGGGGSQVQLKESGPGLVAPSQSLSITCTISGFSLTSYGVHWVRQPPGKGLEWLVVIWSDGSTTYNSALKSRLSISKDNSKSQVFLKMNSLQTDDTAIYYCASHYGSTLAFASWGHGTLVTVSAATREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5112 - protein, 921 aa, Artificial Sequence
  Synthetic Polypeptide encoding a CAR with optional accessory module(s)
MALPVTALLLPLALLLHAARPDIVMTQSHKFMSTSVGDRVSVTCKASQNVGNNVAWYQQKPGQSPKVLIYSASYRYSGVPDRFTGSGSGTDFTLTISNVQSEDLAEYFCQQYNTYPFTFGSGTKLEIKGGGGSGGGGSGGGGSEVQLEESGGGLVQPGGSMKLSCVASGFTFSNYWMNWVRQSPEKGLEWVAEIRFKSHNYATHFAESVKGRFTISRDDSKSSVYLQMNNLRAEDTGIYYCTRRIGNSDYDWWYFDVWGAGTSVTVSSASTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5113 - protein, 917 aa, Artificial Sequence; identical to SEQ ID NO: 4998
  Synthetic Polypeptide encoding a CAR with optional accessory module(s)

SEQ ID NO: 5114 - protein, 923 aa, Artificial Sequence
  Synthetic Polypeptide encoding a CAR with optional accessory module(s)
MALPVTALLLPLALLLHAARPDQSVLTQPPSVSGAPGQRVTISCTGSSSNIGAGYDVHWYQQLPGTAPKLLIYGNSNRPSGVPDRFSGSKSGTSASLAITGLQAEDEADYYCQSYDNSLSSWVFGGGTKLTVLGQPKGGGGSGGGGSGGGGSEVQLQQSGAEVKKPGSSVKVSCKASGGTFSSYAISWVRQAPGQGLEWMGRIIPILGIANYAQKFQGRVTITADKSTSTAYMELSSLRSEDTAVYYCARDVGSGSYSLDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5115 - protein, 920 aa, Artificial Sequence
  Synthetic Polypeptide encoding a CAR with optional accessory module(s)
MALPVTALLLPLALLLHAARPDQSVVTQPPSVSAAPGRKVTISCSGSSSNIGSNYVSWYQQVPGTAPKLLIYEDDKRPSGIPDRFSGSKSGTSATLGITGLQTGDEADYFCATWDRTVNVVRFGGGTRLTVHSQPKGGGGSGGGGSGGGGSQLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARHVGHELDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5116 - protein, 914 aa, Artificial Sequence
  Synthetic Polypeptide encoding a CAR with optional accessory module(s)
MALPVTALLLPLALLLHAARPDIQMTQSPSSLSASVGDRVTITCRASQSISSYLNWYQQKPGKAPKLLIYAASSLQSGVPSGFSGSGSGTDFTLTISSLQPEDFATYYCQQSYSTPLTFGGGTKVEIKRGGGGSGGGGSGGGGSQVQLQESGPGLVKPSETLSLTCTVSGGSVSSGSYYWSWIRQPPGKGLEWIGYIYYSGSTNYNPSLKSRVTISVDTSKNQFSLKLSSVTAADTAVYYCAREGKNGAFDIWGQGTMVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5117 - protein, 800 aa, Artificial Sequence
  Synthetic Polypeptide encoding a CAR with optional accessory module(s)
MALPVTALLLPLALLLHAARPDEFDVQLVESGGGLVQPGGSLRLSCAASGFILDYYAIGWFRQAPGKEREGVLCIDASDDITYYADSVKGRFTISRDNSKNTVYLQMNSLRPEDTAVYYCATPIGLSSSCLLEYDYDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5118 - protein, 963 aa, Artificial Sequence
  Synthetic Polypeptide encoding a CAR with optional accessory module(s)
MALPVTALLLPLALLLHAARPDEFDVQLVESGGGLVQPGGSLRLSCAASGFILDYYAIGWFRQAPGKEREGVLCIDASDDITYYADSVKGRFTISRDNSKNTVYLQMNSLRPEDTAVYYCATPIGLSSSCLLEYDYDYWGQGTLVTVSSLEGGSGSGGGGSGGGGSGSGGSGSGGSGSGGSGSGGSFEVQLVESGGGLVQPGGSLRLSCAASGRTYYLNAMGWFRQAPGKEREFVAAIDWSEGNKDYADSVKGRFTISRDNSKNTVYLQMNSLRPEDTAVYYCAADTPPWGPLIYIESYDSWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5119 - protein, 914 aa, Artificial Sequence
  Synthetic Polypeptide encoding a CAR with optional accessory module(s)
MALPVTALLLPLALLLHAARPDQIVLTQSPAIMSASPGEKVTISCSASSSVSYMYWYQQKPGSSPKPWIYRTSNLASGVPARFSGSGSGTSYSLTISNMEAEDAAAYYCQQYHSYPTTFGGGTKLEVKGGGGSGGGGSGGGGSEVQLVESGGGLVQPKGSLKLSCAASGFSFNTYAMNWVRQAPGKGLEWIAHIRSKSNNFATYYADSVKDRFSISRDASENILFLQMNNLKTEDTAMYYCVRQGGDFPMDYWGQGTSVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5120 - protein, 913 aa, Artificial Sequence
  Synthetic Polypeptide encoding a CAR with optional accessory module(s)
MALPVTALLLPLALLLHAARPDDIQMTQSSSSFSVSLGDRVTITCMASEDIYIRLAWYQQKPGNAPRLLISAATSLETGVPSRFSGSGSGKDYTLSITSLQTEDVGTYYCQQYWSSPWTFGGGTKLEINGGGGSGGGGSGGGGSDVQLQESGPGLVKPSQSLSLTCTVTGYSITSDYTWNWIRQFPGNKLEWMGYITYSGSTSYNPSLKSRNSITRDTSKNQFFLQLNSVTTEDTATYYCARLGRRYTMDYWGQGTSVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5121 - protein, 912 aa, Artificial Sequence
  Synthetic Polypeptide encoding a CAR with optional accessory module(s)
MALPVTALLLPLALLLHAARPDVQLQESGPGLVKPSQSLSLTCTVTGYSITSDYTWNWIRQFPGNKLEWMGYITYSGSTSYNPSLKSRNSITRDTSKNQFFLQLNSVTTEDTATYYCARLGRRYTMDYWGQGTSVTVSSGGGGSGGGGSGGGGSDIQMTQSSSSFSVSLGDRVTITCMASEDIYIRLAWYQQKPGNAPRLLISAATSLETGVPSRFSGSGSGKDYTLSITSLQTEDVGTYYCQQYWSSPWTFGGGTKLEINTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5122 - protein, 913 aa, Artificial Sequence
  Synthetic Polypeptide encoding a CAR with optional accessory module(s)
MALPVTALLLPLALLLHAARPDIQMTQSSSSFSVSLGDRVTITCKASEDIYIRLAWYQQKPGNAPRLLISAATSLETGIPSRFSGSGSGEDYTLTITSLQTEDVATYYCQQYWTTPWTFGGGTKLEIKRGGGGSGGGGSGGGGSDVQLQESGPGLVKPSQSLSLTCTVTGYSITIDYTWNWIRQFPGNKLEWMGYITYSGSTDYNPSLKSRSSITRDTSMNQFFLQLNSVTTEDTATYYCARLGRRYALDYWGQGTSVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5123 - protein, 914 aa, Artificial Sequence
  Synthetic Polypeptide encoding a CAR with optional accessory module(s)
MALPVTALLLPLALLLHAARPDIVMTQAAPSIPVTPGESVSISCRSDKSLLHSNGNTYLFWFLQRPGQSPQLLIYRMSNLASGVPDRFSGSGSGTAFTLRISGVEAEDVGVYYCMQHLEYPYTFGGGTKLEIKGGGGSGGGGSGGGGSQVQLQQSGPELVKPGASVKMSCKASGYAFSSSWLNWVRQRPGKGLEWIGRIYPGDGENHYNGKFKGKATLTADKSSSTGYMQLSSLTSEDSAVYFCASYYEGGYWGQGTLITVSATREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5124 - protein, 913 aa, Artificial Sequence
  Synthetic Polypeptide encoding a CAR with optional accessory module(s)
MALPVTALLLPLALLLHAARPDIVLTQSPASLAVSLGQSVTISCRASESVEYYGTSLMQWYQQKPGQPPKLLIYGASNVESGVPARFSGSGSGTDFSLNIHPVEEDDIAMYFCQQSRKVPWTFGGGTKLEIKGGGGSGGGGSGGGGSEVKLVESGGGLVKPGGSRKLSCAASGFTFSSYTMSWVRQTPAKRLEWVATISSGSSTIYYADTVKGRFTISRDNAKNTLFLQMTSLRSEDTAMYYCARRWFLDCWGQGTTLTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5125 - protein, 916 aa, Artificial Sequence
  Synthetic Polypeptide encoding a CAR with optional accessory module(s)
MALPVTALLLPLALLLHAARPDQVQLQQSGPGLVKPSETLSLTCTVSGDSISSYYWSWIRQPPGKGLEWIGYIYYSGSTNYNPSLKSRVTISVDTSKSQFSLKLSSVTAADTAVYYCARGRYFDVWGRGTMVTSSGGGGSGGGGSGGGGSSSYVLTQPPSVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLGAAATREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5126 - protein, 917 aa, Artificial Sequence
  Synthetic Polypeptide encoding a CAR with optional accessory module(s)
MALPVTALLLPLALLLHAARPDIVMTQSPLSLPVTPGEPASISCRSSKSLLHSNGNTYLYWFQQKPGQAPRLLIYRMSNLASGVPDRFSGSGSGTAFTLKISRVEAEDVGVYYCMQHIEYPFTFGQGTKLEIKGGGGSGGGGSGGGGSQVQLVQSGPEVKKPGASVKVSCKASGYTFTNSWMNWVRQRPGKGLEWIGRIYPGDGETIYNGKFRVRVTITADESTSTAYMELSSLRSEDTAVYYCARGYDDYSFAYWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5127 - protein, 917 aa, Artificial Sequence
  Synthetic Polypeptide encoding a CAR with optional accessory module(s)
MALPVTALLLPLALLLHAARPDEIVMTQSPATLSLSPGERATLSCRASQSVSSYLAWYQQKPGQAPRLLIYDASNRATGIPARFSGSGSGTDFTLTISSLEPEDFAVYYCHQYGSSPQTFGQGTKVEIKRGGGGSGGGGSGGGGSEVQLVQSGAEVKKPGSSVKVSCKASGGTFSSYAISWVRQAPGQGLEWMGGIIPIFGTANYAQKFQGRVTITADESTSTAYMELSSLRSEDTAVYYCAVHYGDYVFSSMDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5128 - protein, 920 aa, Artificial Sequence
  Synthetic Polypeptide encoding a CAR with optional accessory module(s)
MALPVTALLLPLALLLHAARPDETTLTQSPGTLSLSPGERATLSCRASQSVSSSYLAWYQQKPGQAPRLLIYGASSRATGIPDRFSGSGSGTDFTLTISRLEPEDFAVYYCQQYGSSPRTFGQGTKVEIKRGGGGSGGGGSGGGGSEVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGPEYCINGVCSLDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5129 - protein, 922 aa, Artificial Sequence
  Synthetic Polypeptide encoding a CAR with optional accessory module(s)
MALPVTALLLPLALLLHAARPDIELTQSPSSLAVSAGEKVTMSCKSSQSLLNSRTRKNQLAWYQQKPGQSPELLIYWASTRQSGVPDRFTGSGSGTDFTLTISSVQAEDLAVYYCQQSYNLLTFGPGTKLEVKRGGGGSGGGGSGGGGSVKLQESGGGFVKPGGSLKVSCAASGFTFSSYAMSWVRLSPEMRLEWVATISSAGGYIFYSDSVQGRFTISRDNAKNTLHLQMGSLRSGDTAMYYCARQGFGNYGDYYAMDYWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5130 - protein, 921 aa, Artificial Sequence
  Synthetic Polypeptide encoding a CAR with optional accessory module(s)
MALPVTALLLPLALLLHAARPDIQMTQSPSSLSASVGDRVTITCRSSQNIVHSNGNTYLDWYQQTPGKAPKLLIYKVSNRFSGVPSRFSGSGSGTDFTFTISSLQPEDIATYYCFQYSHVPWTFGQGTKLQIGGGGSGGGGSGGGGSQVQLQQSGAEVKKPGSSVKVSCKASGYTFTNYYIYWVRQAPGQGLEWIGGINPTSGGSNFNEKFKTRVTITADESSTTAYMELSSLRSEDTAFYFCTRQGLWFDSDGRGFDFWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5131 - protein, 817 aa, Artificial Sequence
  Synthetic Polypeptide encoding a CAR with optional accessory module(s)
MALPVTALLLPLALLLHAARPLFNQEVQIPLTESYCGPCPKNWICYKNNCYQFFDESKNWYESQASCMSQNASLLKVYSKEDQDLLKLVKSYHWMGLVHIPTNGSWQWEDGSILSPNLLTIIEMQKGDCALYASSFKGYIENCSTPNTYICMQRTVGGGGSGGGGDTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5132 - protein, 911 aa, Artificial Sequence
  Synthetic Polypeptide encoding a CAR with optional accessory module(s)
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIKRGGGGSGGGGSGGGGSQVHLQESGPGLVKPSETLSLTCTVSDDSISSYYWSWIRQPPGKGLEWIGHISYSGSANYNPSLKSRVTISVDTSKNQFSLKLSSVTAADTAVYYCANWDDAFNIWGQGTMVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5133 - protein, 913 aa, Artificial Sequence
  Synthetic Polypeptide encoding a CAR with optional accessory module(s)
MALPVTALLLPLALLLHAARPDVVMTQTPLTLSVTIGQPASISCKSSQSLLDSDGKTYLHWLLQRPGQSPKRLIFLVSKLDSGVPDRFTGSGSGTDFTLKISRVEAEDLGVYYCWQGTHFPQTFGGGTKLEIKGGGGSGGGGSGGGGSVQLQESGPDLVKPSQSLSLTCTVTGYSITSGYSWHWIRQFPGNKLEWMGYIHYSGDTDYNPSLKSRFSITRDTSKNQFFLQLNSVTTEDTATYYCATPGGFVYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5134 - protein, 917 aa, Artificial Sequence
  Synthetic Polypeptide encoding a CAR with optional accessory module(s)
MALPVTALLLPLALLLHAARPDQSELTQPRSVSGSPGQSVTISCTGTERDVGGYNYVSWYQQHPGKAPKLIIHDVIERSSGVPDRFSGSKSGNTASLTISGLQAEDEADYYCWSFAGGYYVFGTGTDVTVLGGGGSGGGGSGGGGSFEVQLLESGGGLVQPGGSLRLSCAASGFTFSTYQMSWVRQAPGKGLEWVSGIVSSGGSTAYADSVKGRFTISRDNSKNTLYLQMNSLRAEDTAVYYCAGELLPYYGMDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5135 - protein, 916 aa, Artificial Sequence
  Synthetic Polypeptide encoding a CAR with optional accessory module(s)
MALPVTALLLPLALLLHAARPDQSELTQPRSVSGSPGQSVTISCTGTERDVGGYNYVSWYQQHPGKAPKLIIHDVIERSSGVPDRFSGSKSGNTASLTISGLQAEDEADYYCWSFAGGYYVFGTGTDVTVLGGGGSGGGGSGGGGSEVQLLESGGGLVQPGGSLRLSCAASGFTFSTYEMHWVRQAPGKGLEWVSVILSSGGETNYADSVKGRFTISRDNSKNTLYLQMNSLRAEDTAVYYCAGMLLPYYGMDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5136 - protein, 818 aa, Artificial Sequence
  Synthetic Polypeptide encoding a CAR with optional accessory module(s)
MALPVTALLLPLALLLHAARPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5137 - protein, 913 aa, Artificial Sequence
  Synthetic Polypeptide encoding a CAR with optional accessory module(s)
MALPVTALLLPLALLLHAARPDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRGGGGSGGGGSGGGGSEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5138 - protein, 914 aa, Artificial Sequence
  Synthetic Polypeptide encoding a CAR with optional accessory module(s)
MALPVTALLLPLALLLHAARPAIVMTQTPSPVSAAVGGTVTINCQASESVYSNNYLSWFQQKPGQPPKLLIYLASTLASGVPSRFKGSGSGTQFTLTISGVQCDDAATYYCIGGKSSSTDGNAFGGGTEVVVRGGGGSGGGGSGGGGSQSLEESGGRLVKPDETLTITCTVSGIDLSSNGLTWVRQAPGEGLEWIGTINKDASAYYASWAKGRLTISKPSSTKVDLKITSPTTEDTATYFCGRIAFKTGTSIWGPGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5139 - protein, 912 aa, Artificial Sequence
  Synthetic Polypeptide encoding a CAR with optional accessory module(s)
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKGGGGSGGGGSGGGGSQVQLVQSGAEVKKPGASVKVSCKASGYTFTSYDVHWVRQAPGQRLEWMGWLHADTGITKFSQKFQGRVTITRDTSASTAYMELSSLRSEDTAVYYCARERIQLWFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5140 - protein, 931 aa, Artificial Sequence
  Synthetic Polypeptide encoding a CAR with optional accessory module(s)
MALPVTALLLPLALLLHAARPDDIVMTQSPLSLPVTPGEPASISCRSSQSLLHSNGYNYLVWYLQKPGQSPQLLIYLGSIRASGVPDRFSGSGSGTDFTLKISRVEAEDVGVYYCMQPLQTPITFGQGTRLEIKRGGGGSGGGGSGGGGSGLQCVAAPRWVLSQVQLQQWGAGLLKPSETLSLTCAVYGGSFSGNYWSWIRQPPGKGLEWIGEINHSGSTNYNPSLKSRVTISVDTSKNQFSLKLSSVTAADTAVYYCARGGSYNYFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5141 - protein, 928 aa, Artificial Sequence
  Synthetic Polypeptide encoding a CAR with optional accessory module(s)
MALPVTALLLPLALLLHAARPDQLTQSPSSVSASVGDRVTITCRASRGISSWLAWYQQKPGKAPKLLIYTASSLQSGVPSRFSGSGSGTDFTLTISSLQPEDFATYYCQQAYSFPRTFGQGTKVEIKRGGGGSGGGGSGGGGSVAAPRWVLSQVQLQESGPGLVKPSQTLSLTCTVSGGSISSGGYYWIWIRQHPGKGLEWIGYIYYNGNTYYNPSLKSRVTMSVDTSKNQFSLKLSSVTAADTAVYYCARDGITMIRGYYYGMDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5142 - protein, 902 aa, Artificial Sequence
  Synthetic Polypeptide encoding a CAR with optional accessory module(s)
MALPVTALLLPLALLLHAARPDIVVTQSPASLAVSLGQRATISYRASKSVSTSGYSYMHWNQQKPGQPPRLLIYLVSNLESGVPARFSGSGSGTDFTLNIHPVEEEDAATYYCQHIRELTRSEGGPSWKGGGGSGGGGSGGGGSEVKLEESGGDLVKPGGSLKLSCAASGFTFSGYGMSWVRQTPDKRLEWVATISSGGSYTYYPDSVKGRFTISRDNAKNTLYLQMSSLKSEDTAMYYCARHEGGYYGSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5143 - protein, 918 aa, Artificial Sequence
  Synthetic Polypeptide encoding a CAR with optional accessory module(s)
MALPVTALLLPLALLLHAARPDDIQMTQSPSSLSASVGDRVTITCRASQGISNYLAWYQQKTGKVPKFLIYEASTLQSGVPSRFSGGGSGTDFTLTISSLQPEDVATYYCQNYNSAPFTFGPGTKVDIKGGGGSGGGGSGGGGSQVQLVESGGGVVQPGRSLRLSCAASGFAFSRYGMHWVRQAPGKGLEWVAVIWYDGSNKYYADSVKGRFTISRDNSKNTQYLQMNSLRAEDTAVYYCARGGDFLYYYYYGMDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5144 - protein, 909 aa, Artificial Sequence
  Synthetic Polypeptide encoding a CAR with optional accessory module(s)
MALPVTALLLPLALLLHAARPDIQMTQSPSSLSTSVGDRVTLTCKASQDVGTAVDWYQQKPGPSPKLLIYWASTRHTGIPSRFSGSGSGTDFTLTISSLQPEDFADYYCQQYNSYPLTFGPGTKVDIKGGGGSGGGGSGGGGSEVQLVQSGPEVKKPGATVKISCKTSGYTFTEYTIHWVKQAPGKGLEWIGNINPNNGGTTYNQKFEDKATLTVDKSTDTAYMELSSLRSEDTAVYYCAAGWNFDYWGQGTLLTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5145 - protein, 910 aa, Artificial Sequence
  Synthetic Polypeptide encoding a CAR with optional accessory module(s)
MALPVTALLLPLALLLHAARPDIQMTQSPSSLSASVGDRVTITCKASQDIYPYLNWFQQKPGKAPKTLIYRTNRLLDGVPSRFSGSGSGTDFTFTISSLQPYYCLQYDEFPLTFGAGTKLEIKRGGGGSGGGGSGGGGSQITLKESGPTLVKPTQTLTLTCTFSGFSLSTSNMGVGWIRQPPGKALEWLAHIWWDDDKYYSPSLKSRLTITKDTSKNQVVLTMTNMDPVDTATYYCVRSNYGYAWFAYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5146 - protein, 910 aa, Artificial Sequence
  Synthetic Polypeptide encoding a CAR with optional accessory module(s)
MALPVTALLLPLALLLHAARPDIVMTQSQKFMSTSVGDRVNVTCKASQNVGTNVVWYQQKTGQSPKALIHSASYRYSGVPDRFTGSGSGTDFTLTLSNVQSEDLAEYFCQHYNSFPYTFGGGTKLEIKRGGGGSGGGGSGGGGSQVQLQQSGAELVRPGVSVKISCKGSGYRFTDYPIHWVKQSHAKSLEWIGIISTYYGDVTNNPKFRGKATMTVDKSSTTAYMELARLTSEDSAIYYCARNDLFAYWGQGTLVTVSATREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5147 - protein, 913 aa, Artificial Sequence
  Synthetic Polypeptide encoding a CAR with optional accessory module(s)
MALPVTALLLPLALLLHAARPDIKMTQSPSSMYASLGERVTITCKASPDINSYLSWFQQKPGKSPKTLIYRANRLVDGVPSRFSGGGSGQDYSLTINSLEYEDMGIYYCLQYDEFPYTFGGGTKLEMKGGGGSGGGGSGGGGSEVKLVESGGGLVKPGGSLKLSCAASGFTFSSYAMSWVRQIPEKRLEWVASISRGGTTYYPDSVKGRFTISRDNVRNILYLQMSSLRSEDTAMYYCGRYDYDGYYAMDYWGQGTSVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5148 - protein, 916 aa, Artificial Sequence
  Synthetic Polypeptide encoding a CAR with optional accessory module(s)
MALPVTALLLPLALLLHAARPDDVVVTPVSCFLSCISGAEGHHLIQGQQKCQYIWLLYALEPTETRTATQTPHLSCIQPRIWGPCQVQWQWVWDRLHPQHPSCGGGGCCNLLLSAHGAYTFGGGTRLELKGGGGSGGGGSGGGGSEVKLQESGPELVKPGASVKMSCKASGYTFTSYVMHWVKQKPGQGLEWIGYINPYNDGTKYNEKFKGKATLTSDKSSSTAYMELSSLTSEDSAVYYCARWKIYYGNYEDYWGQGTPLTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5149 - protein, 946 aa, Artificial Sequence
  Synthetic Polypeptide encoding a CAR with optional accessory module(s)
MALPVTALLLPLALLLHAARPDEFQVQLVQSGGGLVQPGGSLRLSCAASDFDFAAYEMSWVRQAPGQGLEWVAIISHDGIDKYYTDSVKGRFTISRDNSKNTLYLQMNTLRAEDTATYYCLRLGAVGQGTLVTVSSLEGGGGSGGGGSGGGGSGSGGSGSGGSGSGGSGSGGSFEQVQLVQSGGGLVQPGGSLRLSCAASDFAFDDYEMSWVRQAPGKALEWIGDINHSGTTIYNPSLKSRVTISRDNSKNTLYLQMNTLRAEDTAIYYCARPHYGDYSDAFDIWGQGTMVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5150 - protein, 921 aa, Artificial Sequence
  Synthetic Polypeptide encoding a CAR with optional accessory module(s)
MALPVTALLLPLALLLHAARPEIVMTQSPATLSVSPGERATLSCRASQSVSSNLAWYQQKPGQAPRLLIYGASTRATGIPARFSGSGSGTDFTLTISSLQSVDSAVYYCQQYNNWPPYTFGQGTKLEIKGGGGSGGGGSGGGGSQVQLLESGGGVVQPGRSLRLSCAASGFTFSFYGMHWVRQAPGKGLEWVAAISYDGSNKYYADSVKGRFTISRDNSKNTLYLQMNSLRAEDTAVYYCAKRPNQFYCSDGRCYSIDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5151 - protein, 917 aa, Artificial Sequence
  Synthetic Polypeptide encoding a CAR with optional accessory module(s)
MALPVTALLLPLALLLHAARPQSVLTQPPSASAGGTPGQRVTISCSGSSSNIGSNFVYWYQQLPGTAPKLLIYRNNQRPSGVPDRFSGSRSGTSASLAGLRSEDEADYYCAADSLGGHYVFGTGTKVLGGGGSGGGGSGGGGSQVQLVESGGGSVQPGRSLRLSCEASGFTFEAYAMHWVRQPPGKGLEWVSSINWNSGRIAYADSVKGRFTISRDNARNSLYLQMNSLRLEDTAFYYCAKDIRRFSTGGAEFEYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5152 - protein, 912 aa, Artificial Sequence
  Synthetic Polypeptide encoding a CAR with optional accessory module(s)
MALPVTALLLPLALLLHAARPENVLTQSPAIMSASPGEKVTMTCSASSSVSYMHWYQQKSSTSPKLWIYDTSKLASGVPGRFSGSGSGNSYSLTISSMEAEDVATYYCFQGSGYPLTFGAGTKLELKGGGGSGGGGSGGGGSQVQLKESGPGLVAPSQSLSITCTVSGFSLSSQGVYWVRQPPGKGLEWLGAIWAGGSTNYNSALMSRLSISKDNSKSQVFLKMNSLQTDDTAMYYCARVDGYRGYNMDYWGQGTSVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5153 - protein, 916 aa, Artificial Sequence
  Synthetic Polypeptide encoding a CAR with optional accessory module(s)
MALPVTALLLPLALLLHAARPDDIQMTQSPSSLSASVGDRVTITCRASQSISSYLNWYQQKPGKAPKLLIYDASNLETGVPSRFSGSGSGTDFTFTISSLQPEDIATYYCQQYDNLPLTFGGGTKVDIKRGGGGSGGGGSGGGGSQVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARAHNSSSWSFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5154 - protein, 925 aa, Artificial Sequence
  Synthetic Polypeptide encoding a CAR with optional accessory module(s)
MALPVTALLLPLALLLHAARPDDVVMTQSPLSLPVSLGDQASISCRSSQRLVHSNGNTYLHWYLQKPGQSPKLLIYRVSNRFPGVPDRFSGSGSGTDFTLKISRVEAEDLGIYFCSQSTHVPYTFGGGTKLEIKRGGGGSGGGGSGGGGSEVRLQQSGPDLIKPGASVKMSCKASGYTFTGYVMHWVKQRPGQGLEWIGFINPYNDDIQSNERFRGKATLTSDKSSTTAYMELSSLTSEDSAVYYCARGAGYNFDGAYRFFDFWGQGTTLTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5155 - protein, 916 aa, Artificial Sequence
  Synthetic Polypeptide encoding a CAR with optional accessory module(s)
MALPVTALLLPLALLLHAARPDSYELTQPPSVSVSPGQTATISCSGDQLGGKYGHWYQKKPGQSPVLVLYQDRKRPAGIPERFSGSSSGNTITLTISGTQAVDEADYYCQAWDTNLGGVFGGGTKVTVLGQGGGGSGGGGSGGGGSQVQLVESGAEVKKPGASVKVSCKASGYTFTGYYMHWVRQAPGQGLEWMGRINPNSGGTNYAQKFQGRVTMTRDTSISTAYMELSRLRSDDTAVYYCASPRGRGSAFDIWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5156 - protein, 919 aa, Artificial Sequence
  Synthetic Polypeptide encoding a CAR with optional accessory module(s)
MALPVTALLLPLALLLHAARPDNFMLTQPHSVSESPGKTVTISCTRSSGSIASKYVQWYQQRPGSSPTTVIYEDNQRPSGVPDRFSGSIDTSSNSASLTISGLRTEDEADYYCHSYDSNNHSVFGGGTKVTVLGQGGGGSGGGGSGGGGSEVQLVESGGGVVQPGGSLRLSCAASGFTFSSYAMSWVRQAPGKGLEWVSAISGSGGSTYYADSVKGRFSISRDNSKNTLYLQMNSLRAEDTAVYYCARTRSSGAFDIWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5157 - protein, 914 aa, Artificial Sequence
  Synthetic Polypeptide encoding a CAR with optional accessory module(s)
MALPVTALLLPLALLLHAARPDIQMNQSPSSLSASLGDTITITCHASQNINVWLSWYQQKPGNIPKLLIYKASNLHTGVPSRFSGSGSGTGFTITISSLQPEDIATYYCQQGQSYPWTFGGGTKLEIKRGGGGSGGGGSGGGGSEVQLQQSGPELVKPGASVKISCKASGYSFTGYFMNWVKQSHGKSLEYIGRFNPYNGETLYNQKFKGKATLTVDKSSSTVHMELLSVTSEDSAVYYCGRSGNDDAMDYWGQGTSVTVSSATREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5158 - protein, 915 aa, Artificial Sequence
  Synthetic Polypeptide encoding a CAR with optional accessory module(s)
MALPVTALLLPLALLLHAARPDDIQMTQSPSILSASVGDRVTITCRASQRFGDYLAWYQQKPGQAPKLLIYGASTLQSGVPSRFSGSGSGTEFTLTISGLQPEDFATYYCQQANSFPITFGKGTRLDIRRGGGGSGGGGSGGGGSQVQLVQSGAEVKKPGSSVKVSCKASGGTFSSYAISWVRQAPGQGLEWMGWINVGNGNAIYSQKFQGRVTITRDTSATTAYMELSSLRSEDTAVYYCARDGERAWDLDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5159 - protein, 920 aa, Artificial Sequence
  Synthetic Polypeptide encoding a CAR with optional accessory module(s)
MALPVTALLLPLALLLHAARPDETTLTQSPGTLSLSPGERATLSCRASQSVSSSYLAWYQQKPGQAPRLLIYGASSRATGIPDRFSGSGSGTDFTLTISRLEPEDFAVYYCQQYGSSPYTFGQGTKLEIKRGGGGSGGGGSGGGGSQVQLVQSGGGVVQPGRSLRLSCAASGFTFSSYAMHWVRQAPGKGLEWVAVISYDGSNKYYADSVKGRFTISRDNSKNTLYLQMNSLRAEDTAVYYCARELRFLEWSSDAFDIWGQGTMVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5160 - protein, 915 aa, Artificial Sequence
  Synthetic Polypeptide encoding a CAR with optional accessory module(s)
MALPVTALLLPLALLLHAARPEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKGGGGSGGGGSGGGGSQLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPTMIRGVIDSWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5161 - protein, 912 aa, Artificial Sequence
  Synthetic Polypeptide encoding a CAR with optional accessory module(s)
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKGGGGSGGGGSGGGGSQVQLVQSGAEVRKPGSSVKVSCKASGGSFNNYPIFWVRQAPGQGFEWMGRIIPILGITAYAQKFQGRVTITADKSTSTAYMELNSLRSEDTAVYYCAGGDDLDAFDIWGQGTMVSVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5162 - protein, 924 aa, Artificial Sequence
  Synthetic Polypeptide encoding a CAR with optional accessory module(s)
MALPVTALLLPLALLLHAARPDIVMTQTPLSLPVTPGEPASISCRSSRSLLDSDDGNTYLDWYLQKPGQSPQLLIYTLSYRASGVPDRFSGSGSGTDFTLKISRVEAEDVGVYYCMQRVEFPITFGQGTRLEIKRGGGGSGGGGSGGGGSQVQLVESGGGVVQPGRSLRLSCAASGFIFSRYGMHWVRQAPGKGLKWVAVIWYDGSNKLYADSVKGRFTISRDNSKNTLYLQMNSLRAEDTAVYYCARDYYDNSRHHWGFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5163 - protein, 914 aa, Artificial Sequence
  Synthetic Polypeptide encoding a CAR with optional accessory module(s)
MALPVTALLLPLALLLHAARPEIQMTQSPSSMSASLGDTITITCQATQDIFKNLNWYQQKPGKPPSLLIYYATELAEGVPSRFSGSGSGSDYSLTISNLESEDFAAYYCLQFFEFPFTFGSGTKLEMKGGGGSGGGGSGGGGSQVQLQQSGAELVRPGTSVKVSCKASGYVFTNYWIEWIKQRPGQGLEWIGVMNPGSGETTYNEKFKGKATLTADKSSSTAYMQLSSLTSVDSAVYFCARDHDRDYYAMDYWGQGTSVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5164 - protein, 911 aa, Artificial Sequence
  Synthetic Polypeptide encoding a CAR with optional accessory module(s)
MALPVTALLLPLALLLHAARPDILLTQSPAILSVSPGERVSFSCRASQNIGTSIHWYQQRTNGSPRLLIKYASESVSGIPSRFSGSGSGTDFTLSINSVESEDIADYYCQHTNSWPTTFGGGTKLEIKRGGGGSGGGGSGGGGSQVQLQQSDAELVKPGASVKISCKASGYTFTDHAIHWVKQKPEQGLEWIGYFSPGNGDIKYNEKFKGKATLTADKSSSTAYMQLNSLTSEDSAVYFCKRSYGNYDYWGQGTTLTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5165 - protein, 916 aa, Artificial Sequence
  Synthetic Polypeptide encoding a CAR with optional accessory module(s)
MALPVTALLLPLALLLHAARPDIVMTQSPDSLAVSLGERATINCKSSQSLLNSGDQKNYLTWYQQKPGQPPKLLIYWASTRESGVPDRFSGSGSGTDFTLTISSLQAEDVAVYYCQNDYSYPLTFGQGTKVEIKGGGGSGGGGSGGGGSQVQLVQSGAEVKKTGSSVKVSCKASGYTFTDHAIHVWRQAPGQALEWMGHFSPGNTDIKYNDKFKGRVTLTVDRSMSTAYMELSSLRSEDTAMYYCKTSTFFFDYWGQGTMVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5166 - protein, 838 aa, Artificial Sequence
  Synthetic Polypeptide encoding a CAR with optional accessory module(s)
MELTELLLVVMLLLTARLTLSSPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLLGTQLPPQGRTTAHKDPNAIFLSFQHLLRGKVRFLMLVGGSTLCVRRAPPTTAVPSRTSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5167 - protein, 915 aa, Artificial Sequence
  Synthetic Polypeptide encoding a CAR with optional accessory module(s)
MALPVTALLLPLALLLHAARPDIQMTQSPSSLSASVGDRVTITCKASQDVSIAVAWYQQKPGKAPKVLIYSASYRYTGVPDRFSGSGSGTDFTFTISSLQPEDIAVYYCQQHYITPLTFGGGTKVEIKGGGGSGGGGSGGGGSQIQLVQSGHEVKKPGASVKVSCKASGYTFTNYGMNWVRQAPGQGLEWMGWINTKTGEPTYAEEFKGRFVFSLETSASTAYLQISSLKAEDTAMYFCGRGGYGSSYWYFDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5168 - protein, 917 aa, Artificial Sequence
  Synthetic Polypeptide encoding a CAR with optional accessory module(s)
MALPVTALLLPLALLLHAARPDIVMTQSPDSLAVSLGERATINCRASKSVSTSGYSYMHWYQQKPGQPPKLLIYLASNLESGVPDRFSGSGSGTDFTLTISSLQAEDVAVYYCQHSRELPYTFGQGTKLEIKGGGGSGGGGSGGGGSQVQLQESGPGLVKPSETLSLTCTVSGGSISSYGVHWIRQPPGKGLEWIGVIWTSGVTDYNSALMGRVTISVDTSKNQFSLKLSSVTAADTAVYYCARDGDYDRYTMDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5169 - protein, 896 aa, Artificial Sequence
  Synthetic Polypeptide encoding a CAR with optional accessory module(s)
MTALFLMSMLFGLACGQAMSFCIPTEYTMHIERRECAYCLTINTTICAGYCMTRDINGKLFLPKYALSQDVCTYRDFIYRTVEIPGCPLHVAPYFSYPVALSCKCGKCNTDYSDCIHEAIKTNYCTKPQKSYLVGFSVGGGGSGGGGSGGGGSAPDVQDCPECTLQENPFFSQPGAPILQCMGCCFSRAYPTPLRSKKTMLVQKNVTSESTCCVAKSYNRVTVMGGFKVENHTACHCSTCYYHKSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5170 - protein, 913 aa, Artificial Sequence
  Synthetic Polypeptide encoding a CAR with optional accessory module(s)
MALPVTALLLPLALLLHAARPQSVLTQPPSVSVSPGQTASITCSGDKLGDKYACWYQQKPGQSPVLVIYQDSKRPSGIPERFSGSNSGNTATLTISGTQAMDEADYYCQAWDSSTAVVFGGGTKLTVLGGGGSGGGGSGGGGSQVQLVQSGAEVKKPGQSLKISCKASGYSLTDNWIGWVRQKPGKGLEWMGIIYPGDSDTRYSPSFQGQVTISADKSINTAYLQWSSLKASDTAIYYCVGLDWNYNPLRYWGPGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5171 - protein, 911 aa, Artificial Sequence
  Synthetic Polypeptide encoding a CAR with optional accessory module(s)
MALPVTALLLPLALLLHAARPDIVMTQSQKFMSTSVGDRVSIICKASQNVGTFVAWYQQKPGQSPKLLVYSASNRYTGVPDRFTGSGSGTDFTLTINNMQSEDLADYFCRQYSSYPYTFGGGTKLEIKGGGGSGGGGSGGGGSEVQLQQSGPELVKPGASMKISCKASGYSFSAYTMNWVKQSHGKNLEWIGLINPYNGGTNYNQEFEGKATLTVNKSSNTAFMELLSLTSDDSAVYYCARRDWDYFDYWGQGTTLTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5172 - protein, 922 aa, Artificial Sequence
  Synthetic Polypeptide encoding a CAR with optional accessory module(s)
MALPVTALLLPLALLLHAARPAIQMTQSPSSLSASVGDRVTITCRASQSISNYLNWYQQKPGKAPKLLIYAASSLQSGVPSRFSGSGSGTDFTLTISSLQPEDFATYYCQQSYSSPSTTFGQGTKLEIKRGGGGSGGGGSGGGGSEVQLVESGGGLIQPGGSLRLSCAASGFTVSSNYMSWVRQAPGKGLEWVSVTYSGGSTSYADSVKGRFTISRDNSKNTLYLQMNSLRAEDTAVYYCARGGRYCSSISCYARSGCDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5173 - protein, 917 aa, Artificial Sequence
  Synthetic Polypeptide encoding a CAR with optional accessory module(s)
MALPVTALLLPLALLLHAARPDIQMTQSPSSLSASVGDRVTITCRASQSIGTSLHWYQQKPGKAPKLLIKFASRLQSGVPSRFSGSGSGTDFTLTISSLQPEDFATYYCQQSPGFPPTFGQGTKLEIKRGGGGSGGGGSGGGGSQVQLVESGGGLVKPGGSLRLSCAASGFSITTSGYYWTWIRQFPGKGLEWMGYIGYNSKTYYNPALKSRITISRDNAKNSLYLQMNSLRAEDTAVYYCARSLYGGYKDAFDSWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5174 - protein, 922 aa, Artificial Sequence
  Synthetic Polypeptide encoding a CAR with optional accessory module(s)
MALPVTALLLPLALLLHAARPDEIVLTQSPLSLPVTPGEPASISCRSSQSLLHSIGYNYLDWYLQKPGQSPQLLIYLGSNRASGVPDRFSGSGSGTDFTLKISRVEAEDVGVYYCMQALQTPLTFGGGTKVEIKRGGGGSGGGGSGGGGSEVQLVESGGGVVQPGRSLRLSCAASGFTFRSYGMHWVRQAPGKGLEWVAVISYDGSNKYYTDSVNGRFTISRDNSKNTLYLQMNSLRAEDTAVYYCARGGGYYETSGPDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5175 - protein, 920 aa, Artificial Sequence
  Synthetic Polypeptide encoding a CAR with optional accessory module(s)
MALPVTALLLPLALLLHAARPDDVVMTQSPLSLPVTPGEPASISCRSSQSLLHSIGYNYLHWFLQKPGQSPQLLIYLGSNRASGVPDRFSGSGSGTDFTLKISRVEAEDVGVYYCMQALQTPPTFGQGTRLEIKRGGGGSGGGGSGGGGSQLQLQESGPGLVKPSGTLSLTCAVSGGSISSSNWWSWVRQPPGKGLEWIGEIYHSGSTNYNPSLKSRVTISVDKSKNQFSLKLSSVTAADTAVYYCVGSPYGDYVLDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5176 - protein, 923 aa, Artificial Sequence
  Synthetic Polypeptide encoding a CAR with optional accessory module(s)
MALPVTALLLPLALLLHAARPDVVMTQSPLSLPVTPGEPASISCRSSQSLLHSNGHNYLDWYLQKPGQSPQLLIYLGSNRASGVPDRFSGSGSGTDFTLKISRVEAEDVGVYYCMQTLQTPLTFGPGTKVDIKRGGGGSGGGGSGGGGSEVQLVETGGGVVQPGRSLRLSCAASGFTFSSYGMHWVRQAPGKGLEWVAVISYDGSNKYYADSVKGRFTISRDNSKNTLYLQMNSLRAEDTAVYYCAKDRYGWGSSFGHFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5177 - protein, 918 aa, Artificial Sequence
  Synthetic Polypeptide encoding a CAR with optional accessory module(s)
MALPVTALLLPLALLLHAARPDEIVLTQSPGTLSLSLGERATLSCRASQSISSSFLAWYQQKPGQAPKLLIYAASTRATGIPDRFSGSGSGTDFTLTISRLEPEDFAVYYCQQYGRSLSFGGGTKVEVKGGGGSGGGGSGGGGSQVQLQQSGPGLVKPSQTLSLTCAISGDSVSGNSATWNWIRQSPSRGLEWLGRTYYRSKWNHDYAESVKSRITINPDTSKNQFSLQLNSVTPEDTAVYYCARGDSSSWYAFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5178 - protein, 918 aa, Artificial Sequence
  Synthetic Polypeptide encoding a CAR with optional accessory module(s)
MALPVTALLLPLALLLHAARPDQTVVTQPPSASGTPGQRVTISCSGSSSNIGSNYVYWYQQLPGTAPKLLIYRSNQRPSGVPDRFSGSKSGTSASLAISGPRSVDEADYYCAAWDDSLNGVVFGGGTKLTVLGGGGGSGGGGSGGGGSQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARRIPPYYGMDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5179 - protein, 918 aa, Artificial Sequence
  Synthetic Polypeptide encoding a CAR with optional accessory module(s)
MALPVTALLLPLALLLHAARPDQSVVTQPPSVSVAPGKTARITCGRNNIGSKSVHWYQQKPGQAPVLVVYDDSDRPSGIPERFSGSNSGNTATLTISRVEAGDEADYYCQVWDSSSDHVVFGGGTKLTVLGGGGGSGGGGSGGGGSEVQLVQSGGGVVRPGGSLRLSCAASGFTFDDYGMSWVRQAPGKGLEWVSGINWNGGSTGYADSVRGRFTISRDNAKNSLYLQMNSLRAEDTALYYCARERGYGYHDPHDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5180 - protein, 930 aa, Artificial Sequence
  Synthetic Polypeptide encoding a CAR with optional accessory module(s)
MALPVTALLLPLALLLHAARPEQKLISEEDLEFQAVVTQPPSASGTPGQRVTISCSGSSSNIGSNTVNWYQQVPGTAPKLLIYSNNQRPSGVPDRFSGSKSGTSASLAISGLQSEDEADYYCAAWDDSLNGWVFGGGTKLTVLGGGGSGGGGSGGGGSQMQLVQSGAEVKEPGESLRISCKGSGYSFTNFWISWVRQMPGKGLEWMGRVDPGYSYSTYSPSFQGHVTISADKSTSTAYLQWNSLKASDTAMYYCARVQYSGYYDWFDPWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5181 - protein, 924 aa, Artificial Sequence
  Synthetic Polypeptide encoding a CAR with optional accessory module(s)
MALPVTALLLPLALLLHAARPEQKLISEEDLEFDIQMTQSPSTLSASVGDRVTITCRASQNINKWLAWYQQRPGKAPQLLIYKASSLESGVPSRFSGSGSGTEYTLTISSLQPDDFATYYCQQYNSYATFGQGTKVEIKRGGGGSGGGGSGGGGSQVQLVQSGAEVKKPGESLKISCKGSGYNFSNKWIGWVRQLPGRGLEWIAIIYPGYSDITYSPSFQGRVTISADTSINTAYLHWHSLKASDTAMYYCVRHTALAGFDYWGLGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5182 - protein, 914 aa, Artificial Sequence
  Synthetic Polypeptide encoding a CAR with optional accessory module(s)
MALPVTALLLPLALLLHAARPEIVLTQSPGTLSLSPGERATLSCRASQSVSNTYLAWYHQRPGQAPRLLIYGASSRATGIPDRFSGSGSGTDFALTISSLEPEDFAVYYCQQYSNSWTFGQGTKVEIKRGGGGSGGGGSGGGGSQVQLVESGGGVVQPGRSLRLSCAASGFTFSSYDMHWVRQAPGKGLEWVAVISYDGTNEYYADSVKGRFTISRDTSKNTLYLQMNSLRAEDTAVYYCARERYFDWSFDYWGQGTLVSVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5183 - protein, 913 aa, Artificial Sequence
  Synthetic Polypeptide encoding a CAR with optional accessory module(s)
MALPVTALLLPLALLLHAARPELTQDPAVSVALGQTVRITCQGDSLRSNYANWYQQKPGQAPVLVIYGQNNRPSGIPDRFSGSSSGNTASLTITGAQAADEADYYCDSRVSTGNHVVFGGGTKLTVLGQGGGGSGGGGSGGGGSEVQLVQSGAEVKKPGASVKVSCKASGYTFTSYAMHWVRQAPGQRLEWMGWINAGNGNTKYSQKFQGRVTITRDTSASTAYMELSSLRSEDTAVYYCARDISYGSFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5184 - protein, 915 aa, Artificial Sequence
  Synthetic Polypeptide encoding a CAR with optional accessory module(s)
MALPVTALLLPLALLLHAARPDIVLTQTPATLSVTPGDSVSLSCRASQSISNNLHWYQQKSHESPRLLIKNASQSISGIPSKFSGSGSGTDFTLRINSVETEDFGMYFCQQSNSWPYTFGSGTKLEIKGGGGSGGGGSGGGGSQVKLQQSGPELVKPGASVKISCKASGYSFTGYYMHWVKQSHGNILDWIGYIYPYNGVSSYNQKFKGKATLTVDKSSSTAYMELRSLTSEDSAVYYCARERGLYQLRAMDYWGQGTSVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5185 - protein, 906 aa, Artificial Sequence
  Synthetic Polypeptide encoding a CAR with optional accessory module(s)
MALPVTALLLPLALLLHAARPDIVMTQTPAIMSASPGQKVTITCSASSSVNYMHWYQQKLGSSPKLWIYDTSKLAPGVPARFSGSGSGTSYSLTISSMEAEDAASYFCHQWSSYPYTFGSGTKLEIKGGGGSGGGGSGGGGSEVQLQESGPDLVKPSQSLSLTCTVTGYSITSGYGWHWIRQFPGNKLEWMGYIHYSGSTTYNPSLKSRISISRDTSKNQFFLQLNSVTTEDTATYYCARSLRYWGQGTTLTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5186 - protein, 909 aa, Artificial Sequence
  Synthetic Polypeptide encoding a CAR with optional accessory module(s)
MALPVTALLLPLALLLHAARPDIQMTQSPSSLSASVGDRVTITCSATSSISYMHWYQQKPGKAPKGWIYDTSKLAHGVPSRFSGSGSGTDFTLTISSLQPEDFATYYCHQRRSYPFTFGQGTKVEIKGGGGSGGGGSGGGGSEVQLVQSGAEVKKPGASVKVSCKASGYTFTNFWIHWVRQAPGQGLEWIGEIDPSDSYTNYNQKFKGRVTITRDTSTSTAYLELSSLRSEDTAVYYCAREITTVDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5187 - protein, 916 aa, Artificial Sequence
  Synthetic Polypeptide encoding a CAR with optional accessory module(s)
MALPVTALLLPLALLLHAARPDIQMTQSPSSLSASVGDRVTITCKASQGFNKYVAWYQQKPGKAPKLLIYYTSTLQPGVPSRFSGSGSGRDYTLTISSLQPEDFATYYCLQYGNLLYAFGQGTKVEIKRGGGGSGGGGSGGGGSEVQLVQSGAEVKKPGASVKVSCKASGYTFTSYWIGWVRQAPGQGLEWIGDIYPGGGYTNYNEKFKGRVTITRDTSTSTAYLELSSLRSEDTAVYYCARLDGSSYRGAMDSWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5188 - protein, 920 aa, Artificial Sequence
  Synthetic Polypeptide encoding a CAR with optional accessory module(s)
MALPVTALLLPLALLLHAARPDIQLTQSPSSLSASVGDRVTITCRASQSVDYDGDSYMNWYQQKPGKAPKLLIYAASYLESGVPSRFSGSGSGTDFTLTISSLQPEDFATYYCQQSHEDPYTFGQGTKVEIKRGGGGSGGGGSGGGGSEVQLVESGGGLVQPGGSLRLSCAVSGYSITSGYSWNWIRQAPGKGLEWVASITYDGSTNYNPSVKGRITISRDDSKNTFYLQMNSLRAEDTAVYYCARGSHYFGHWHFAVWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5189 - protein, 912 aa, Artificial Sequence
  Synthetic Polypeptide encoding a CAR with optional accessory module(s)
MALPVTALLLPLALLLHAARPDIQMTQSPSSLSASVGDRVTITCRASQDIRYYLNWYQQKPGKAPKLLIYVASSLQSGVPSRFSGSGSGTEFTLTVSSLQPEDFATYYCLQVYSTPRTFGQGTKVEIKGGGGSGGGGSGGGGSEVQLVESGGGLAKPGGSLRLSCAASGFRFTFNNYYMDWVRQAPGQGLEWVSRISSSGDPTWYADSVKGRFTISRENAKNTLFLQMNSLRAEDTAVYYCASLTTGSDSWGQGVLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5190 - protein, 913 aa, Artificial Sequence
  Synthetic Polypeptide encoding a CAR with optional accessory module(s)
MALPVTALLLPLALLLHAARPEIVMTQSPATLSVSPGERATLSCRASQSVSRNLAWYQQKPGQAPRLLIYGASTRATGIPARFSGSGSGTEFTLTIGSLQSEDFAVYYCQQYKTWPRTFGQGTNVEIKGGGGSGGGGSGGGGSQVQLQQWGAGLLKPSETLSLTCAVFGGSFSGYYWSWIRQPPGKGLEWIGEINHRGNTNDNPSLKSRVTISVDTSKNQFALKLSSVTAADTAVYYCARERGYTYGNFDHWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5191 - protein, 914 aa, Artificial Sequence
  Synthetic Polypeptide encoding a CAR with optional accessory module(s)
MALPVTALLLPLALLLHAARPEIVMTPSSATLSVSPGERATLSCRASQSVSRNLAWYQQKPGQAPRLLIYGASTRATGIPARFSGSGSGTEFTLTISSLQSEDFAVYYCHQYSNWMCSFGQGTKLEIKGGGGSGGGGSGGGGSEVQLLESGGGLVQPGGSLRLSCAASGFTFSRYAMNWVRQAPGKGLEWVSGISGSGGRTYYADSVKGRFTISRDNSKNTLYLQMNSLRAEDTAVYYCAKDRDFWSGPFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5192 - protein, 914 aa, Artificial Sequence; identical to SEQ ID NO: 5191
  Synthetic Polypeptide encoding a CAR with optional accessory module(s)

SEQ ID NO: 5193 - protein, 916 aa, Artificial Sequence
  Synthetic Polypeptide encoding a CAR with optional accessory module(s)
MALPVTALLLPLALLLHAARPQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSELVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5194 - protein, 917 aa, Artificial Sequence
  Synthetic Polypeptide encoding a CAR with optional accessory module(s)
MALPVTALLLPLALLLHAARPEVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDKGGGYYDFWSGSDYWGQGTLVTVSSGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCNSRDSSGWVFGGGTKLTVLTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5195 - protein, 926 aa, Artificial Sequence
  Synthetic Polypeptide encoding a CAR with optional accessory module(s)
MALPVTALLLPLALLLHAARPEVQLQQSGPGLVKPSQTLSLTCAISGDSVLSNSDTWNWIRQSPSRGLEWLGRTYHRSTWYDDYASSVRGRVSINVDTSKNQYSLQLNAVTPEDTGVYYCARDRLQDGNSWSDAFDVWGQGTMVTVSSGGGGSGGGGSGGGGSQSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTLVYVFGTGTKVTVLTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5196 - protein, 924 aa, Artificial Sequence
  Synthetic Polypeptide encoding a CAR with optional accessory module(s)
MALPVTALLLPLALLLHAARPQVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARGDSNYWSYYGMDVWGQGTLVTVSSGGGGSGGGGSGGGGSGGGGSQSVLTQPRSVSGSPGQSVTISCTGTSSDVGGYNYVSWYQQHPGEAPKLIIYDADKRPSGISNRFSSGKSGNTASLTISGLQVEDEADYYCCSYAGGSTWVFGGGTKVTVLTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5197 - protein, 926 aa, Artificial Sequence
  Synthetic Polypeptide encoding a CAR with optional accessory module(s)
MALPVTALLLPLALLLHAARPEVQLQQSGPGLVKPSQTLSLTCAISGDSVSSNSAAWNWIRQSPSRGLEWLGRTYYRSKWYSDYAVSVKSRITINPDTSKNQFSLQLNSVTPEDTAVYYCARDPYDFWSGYPDAFDIWGQGTMVTVSSGGGGSGGGGSGGGGSQSALTQPASVSGSPGQSITISCTGTSSDVGGYNYVSWYQQHPGKAPKVIISEVNNRPSGVSHRFSGSKSGNTASLTISGLQAEDEADYFCSSYTSGRTLYVFGTGSKVTVLGTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5198 - protein, 925 aa, Artificial Sequence
  Synthetic Polypeptide encoding a CAR with optional accessory module(s)
MALPVTALLLPLALLLHAARPEVQLQQSGPGLVKPSQTLSLTCAISGDSMLSNSDTWNWIRQSPSRGLEWLGRTYHRSTWYDDYASSVRGRVSINVDTSKNQYSLQLNAVTPEDTGVYYCARVRLQDGNSWSDAFDVWGQGTMVTVSSGGGGSGGGGSGGGGSQSALTQPASASGSPGQSVTISCTGTSSDVGGYNYVSWYQQHPGKAPKLMIYDVSNRPSGVSNRFSGSKSGNTASLTISGLQAEDEADYYCSSYTSSSTLYVFGTGTQLTVLTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5199 - protein, 912 aa, Artificial Sequence
  Synthetic Polypeptide encoding a CAR with optional accessory module(s)
MALPVTALLLPLALLLHAARPDVVMTQSPSSLSASVGDRVTITCMASEDIYIRLAWYQQKPGNAPKLLIYAATSLETGVPSRFSGSGSGTDFTLTISSLQPEDFATYYCQQYWSSPWTFGGGTKVEIKGGGGSGGGGSGGGGSQVQLQESGPGLVKPSQTLSLTCTVSGYSITSDYTWNWIRQPPGNGLEWIGYITYSGSTSYNPSLKSRVLISVDTSKNQVSLKLSSVTAADTAVYYCARLGRRYTMDYWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5200 - protein, 916 aa, Artificial Sequence
  Synthetic Polypeptide encoding a CAR with optional accessory module(s)
MALPVTALLLPLALLLHAARPEIVLTQSPATLSLSPGERATLSCSASSSVSYMYWYQQKPGQAPRLLIYRTSNLASGIPARFSGSGSGTDFTLTISSLEPEDFAVYYCQQYHSYPTTFGQGTKVEIKRTVGGGGSGGGGSGGGGSEVQLVESGGGLVQPGGSLRLSCAASGFSFNTYAMNWVRQAPGKGLEWVSHIRSKSNNFATYYADSVKDRFTISRDNAKNSLYLQMNSLRAEDTAVYYCARQGGDFPMDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5201 - protein, 912 aa, Artificial Sequence
  Synthetic Polypeptide encoding a CAR with optional accessory module(s)
MALPVTALLLPLALLLHAARPDVVMTQSPSSLSASVGDRVTITCKASEDIYIRLAWYQQKPGKAPKLLIYAATSLETGVPSRFSGSGSGTDFTLTISSLQPEDFATYYCQQYWTTPWTFGGGTKVEIKGGGGSGGGGSGGGGSQVQLQESGPGLVKPSQTLSLTCTVSGYSITIDYTWNWIRQPPGKGLEWIGYITYSGSTDYNPSLKSRVLISVDTSKNQVSLKLSSVTAADTAVYYCARLGRRYALDYWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5202 - protein, 914 aa, Artificial Sequence
  Synthetic Polypeptide encoding a CAR with optional accessory module(s)
MALPVTALLLPLALLLHAARPDVVMTQSPSSLSASVGDRVTITCRASQDISKYLNWYQQKPGKAPKLLIYHTSRLHSGVPSRFSGSGSGTDFTLTISSLQPEDFATYYCQQGNTLPYTFGGGTKVEIKGGGGSGGGGSGGGGSQVQLQESGPGLVKPSQTLSLTCTVSGVSLPDYGVSWIRQPPGKGLEWIGVIWGSETTYYNSALKSRVLISVDTSKNQVSLKLSSVTAADTAVYYCARHYYYGGSYAMDYWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5203 - protein, 921 aa, Artificial Sequence
  Synthetic Polypeptide encoding a CAR with optional accessory module(s)
MALPVTALLLPLALLLHAARPEIVLTQSPATLSLSPGERATLSCRASQSVSIYLAWYQQKPGQAPRLLIYDASNRATGIPARFSGSGSGTDFTLTISSLEPEDFAVYYCQQRSNWPPFTFGPGTKVDIKGGGGSGGGGSGGGGSQVQLVESGGGVVQPGRSLRLSCAASGFTFSSYGMHWVRQAPGKGLEWVAVIWDDGSNKYYVDSVKGRFTISRDNSKNTLYLQMNSLRAEDTAVYYCARDDYYGSGSFNSYYGTDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5204 - protein, 906 aa, Artificial Sequence
  Synthetic Polypeptide encoding a CAR with optional accessory module(s)
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKGGGGSGGGGSGGGGSEVQLVQSGGGLVHPGGSLRLSCAGSGFTFSTYLMYWVRQAPGKTLEWVSAIGSGGDTYYADSVKGRFTISRDNAKNSLYLQMNSLRAEDMAVYYCARGLGYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5205 - protein, 910 aa, Artificial Sequence
  Synthetic Polypeptide encoding a CAR with optional accessory module(s)
MALPVTALLLPLALLLHAARPQIVLTQSPAIMSASPGEKVTITCSASSSVSYMHWFQQKPGTSPKLWIYSTSNLASGVPARFSGSGSGTSYSLTISRMEAEDAATYYCQQRSSYPPTFGGGTKLEIKGGGGSGGGGSGGGGSQVQLQQSGAELMKPGASVKISCKATGYTFSSYWIEWVKQRPGHGLEWIGEILPGSGSTNYNEKFKGKATFTADTSSNTAYMQLSSLTSEDSAVYYCARYDYPWFAYWGQGTLVTVSATREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5206 - protein, 918 aa, Artificial Sequence
  Synthetic Polypeptide encoding a CAR with optional accessory module(s)
MALPVTALLLPLALLLHAARPDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPFTFGSGTKLEIKGGGGSGGGGSGGGGSQVQLQQPGAELVRPGASVKLSCKASGYTFTSYWINWVKQRPGQGLEWIGNIYPSDSYTNYNQKFKDKATLTVDKSSSTAYMQLSSPTSEDSAVYYCTRSWRGNSFDYWGQGTTLTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5207 - protein, 916 aa, Artificial Sequence
  Synthetic Polypeptide encoding a CAR with optional accessory module(s)
MALPVTALLLPLALLLHAARPDTQMTQSPSSVSASVGDRVTITCRTSQDISNYLNWYQQKPGKAPKLLIYNTSRLHSGVPSRFSGSGSGTDFTLTISSLQPEDFATYYCQQSNMFPYTFGQGTKLEIKGGGGSGGGGSGGGGSQVQLVQSGAEVKKPGASVKVSCKASGYTFNGYFMNWVRQAPGQGLERMGRINPNNGDSFYNQKFQGRVTMTRDTSTSTVYMELPSLRSEDTAVYYCAREGYYGGRGYALDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5208 - protein, 917 aa, Artificial Sequence
  Synthetic Polypeptide encoding a CAR with optional accessory module(s)
MALPVTALLLPLALLLHAARPDIQLTQSPSFLSASVGDRVTITCRASQGISTDLNWYQQKPGKAPKLLIYAASNLESGVPSRFSGSGSGTEFTLTISSLQPEDFATYYCQQSYNWPYTFGGGTKVEIKRGGGGSGGGGSGGGGSEVQLVESGGGLVKPGGSLRLSCAASGFTFSNFEMNWVRQAPGKGLEWVSGISSNGRYINYADSVKGRFTISRDNAKNSLYLQMNSLRAEDTAVYYCARVVDFDQDYNGFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5209 - protein, 915 aa, Artificial Sequence
  Synthetic Polypeptide encoding a CAR with optional accessory module(s)
MALPVTALLLPLALLLHAARPDIQLTQSPSFLSASVGDRVTITCSLSLGISTWRDWFPPRLGRGLEPLTYAASTLQSGVPSRFSGSGSGTEFTLTISSLQPEDFATYYCQQLNSYPLTFGGGTKVEIKRGGGGSGGGGSGGGGSEVQLVESGGGLVKPGGSLRLSCAASGFTFSTYGMSWVRQAPGKGLEWVAYINNGSGYIYYADSVKGRFTISRDNAKNSLYLQMNSLRAEDTAVYYCARGQWWSGGDFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5210 - protein, 918 aa, Artificial Sequence
  Synthetic Polypeptide encoding a CAR with optional accessory module(s)
MALPVTALLLPLALLLHAARPELVMTQSPASLAVSLGQRATISCRASESVDSYGKSFMHWYQLKPGQPPKLLIYRASNLESGVPARFSGSGSRTDFTLTIDPVEADDAATYYCQQNNEDPWTFGGGTKLEIKGGGGSGGGGSGGGGSEVQLEQSGPELVKPGASVKMSCKASGYTFTNYYMKWVKQSHGKSLEWIGDLNPNNGDTFYNQKFKGKATLTVDKSSNTAYMQLNSLTSEDSAVYYCARTGRYEENAMDYWGQGTSVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5211 - protein, 915 aa, Artificial Sequence
  Synthetic Polypeptide encoding a CAR with optional accessory module(s)
MALPVTALLLPLALLLHAARPQSVVTQPPSVSAAPGQKVTISCSGSSSNIGNNYVSWYQQLPGTAPKLLIYDNNKRPSGIPDRFSASKSGTSATLGITGLQTRDEADYYCGTWDSSLSAWVFGGGTKLTVLGGGGGSGGGGSGGGGSQVQLVQSGAEVKKPGSSVKVSCKASGDTFSSYYISWVRQAPGQGLEWMGRIIPILGIANYAQKYQGRVTLSADKSTSTSYMELNSLSSEDTAVYYCALDWSYSIDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5212 - protein, 915 aa, Artificial Sequence
  Synthetic Polypeptide encoding a CAR with optional accessory module(s)
MALPVTALLLPLALLLHAARPQSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSVFGTGTKVLVLGGGGSGGGGSGGGGSQVQLVQSGAEVKKPGSSVKVSCKASGGTFSSYTINVWRQAPGQGLEWMGGFIPISGTVNYAQKFQGRVTITADESTSTAYMELSSLRSEDTAVYYCARPLDWTEDIWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5213 - protein, 918 aa, Artificial Sequence
  Synthetic Polypeptide encoding a CAR with optional accessory module(s)
MALPVTALLLPLALLLHAARPNFMLTQPHSVSESPGKTVTISCTGSSGSIASNYVQWYQQRPGSAPTILIYEDNKRPSGVPDRFSGSIDSSSNSASLTISGLKTGDEADYYCQSYDDINHWVFGGGTKLTVLGGGGGSGGGGSGGGGSEVQLVQSGAEVKKPGASVKVSCKASGYTFTAYYLHWLRQAPGQGLEWMGWMNTNNGATRYAQKFQDRVTMTRDTSINTAYMEMSGLSSDDTAMYYCARGDISQDFADVWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5214 - protein, 925 aa, Artificial Sequence
  Synthetic Polypeptide encoding a CAR with optional accessory module(s)
MALPVTALLLPLALLLHAARPDVMLTQTPLSLPVSLGDQASISCRSSQSILHSTGDTYLEWYLQKPGQSPKLLINKVSNRLSGVPDRFSGSGSGTDFTLKISRVEAEDLGVYYCFQGSHVPWTFGGGTKLEIKRADAAPTVSIFPGGGGSGGGGSGGGGSQVKLQQSGPSLVKPGASVKMSCKASGYTFTDFYMKWVKQSHGKSLEWIGDINPNIGDTFYNQKFKGKATLTVDKSSSTAYMQLNSLTSEDSAVYFCSVGYFDVWGAGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5215 - protein, 140 aa, Artificial Sequence
  Synthetic Polypeptide encoding a CAR with optional accessory module(s)
MALPVTALLLPLALLLHAARPQVKLEESGGGLVQAGRSLRLSCAASEHTFSSHVMGWFRQAPGKERESVAVIGWRDISTSYADSVKGRFTISRDNAKKTLYLQMNSLKPEDTAVYYCAARRIDAADFDSWGQGTQVTVSS

SEQ ID NO: 5216 - protein, 139 aa, Artificial Sequence
  Synthetic Polypeptide encoding a CAR with optional accessory module(s)
MALPVTALLLPLALLLHAARPEVQLVESGGGLVQAGGSLRLSCAASGRTFTMGWFRQAPGKEREFVAAISLSPTLAYYAESVKGRFTISRDNAKNTVVLQMNSLKPEDTALYYCAADRKSVMSIRPDYWGQGTQVTVSS

SEQ ID NO: 5217 - protein, 273 aa, Artificial Sequence
  Synthetic Polypeptide encoding a CAR with optional accessory module(s)
MALPVTALLLPLALLLHAARPQVKLEESGGGLVQAGRSLRLSCAASEHTFSSHVMGWFRQAPGKERESVAVIGWRDISTSYADSVKGRFTISRDNAKKTLYLQMNSLKPEDTAVYYCAARRIDAADFDSWGQGTQVTVSSGGGGSGGGGSGGGGSEVQLVESGGGLVQAGGSLRLSCAASGRTFTMGWFRQAPGKEREFVAAISLSPTLAYYAESVKGRFTISRDNAKNTVVLQMNSLKPEDTALYYCAADRKSVMSIRPDYWGQGTQVTVSS

SEQ ID NO: 5218 - protein, 137 aa, Artificial Sequence
  Synthetic Polypeptide encoding a CAR with optional accessory module(s)
MALPVTALLLPLALLLHAARPEVQLVESGGGLVQAGGSLRLSCIATGKVFSIYDMGWYRQAPGKQRELVAEITSSGTTHYDDFVSGRFTISRDNAKNTVYLQMNTLKAEDTAVYYCRANHVFGGSYWGQGTQVTVSS

SEQ ID NO: 5219 - protein, 143 aa, Artificial Sequence
  Synthetic Polypeptide encoding a CAR with optional accessory module(s)
MALPVTALLLPLALLLHAARPQVQLVESGGGLVQPGGSLRLSCEASGFTLDYYAIGWFRQAPGKEREGVICISRSDGSTYYADSVKGRFTISRDNAKKTVYLQMISLKPEDTAAYYCAAGADCSGYLRDYEFRGQGTQVTVSS

SEQ ID NO: 5220 - protein, 266 aa, Artificial Sequence
  Synthetic Polypeptide encoding a CAR with optional accessory module(s)
MALPVTALLLPLALLLHAARPEVQLVESGGGLVQAGGSLRLSCIATGKVFSIYDMGWYRQAPGKQRELVAEITSSGTTHYDDFVSGRFTISRDNAKNTVYLQMNTLKAEDTAVYYCRANHVFGGSYWGQGTQVTVSSEVAALEKQVQLVESGGGLVQPGGSLRLSCEASGFTLDYYAIGWFRQAPGKEREGVICISRSDGSTYYADSVKGRFTISRDNAKKTVYLQMISLKPEDTAAYYCAAGADCSGYLRDYEFRGQGTQVTVSS

SEQ ID NO: 5221 - protein, 149 aa, Artificial Sequence
  Synthetic Polypeptide encoding a CAR with optional accessory module(s)
MALPVTALLLPLALLLHAARPQVKLEESGGRLVQPRGSLRLSCAGSGRTFSTYGMAWFRQAPGKEREFVASKASMNYSGRTYYADSVKGRFTIARDNAKNMVFLQMNNLKPEDTAVYYCAAGTGCSTYGCFDAQIIDYWGKGTLVTVSS

SEQ ID NO: 5222 - protein, 140 aa, Artificial Sequence
  Synthetic Polypeptide encoding a CAR with optional accessory module(s)
MALPVTALLLPLALLLHAARPQVKLEESGGGLVQPGESLRLSCSASGSIFKVFRVFAMSWYRQGPGKQRELVASISSGETTTYADSVKGRFTISRDNAKNTAYLQMDSLKPEDTAVYYCNADHTFTGDFWGQGTQVTVSS

SEQ ID NO: 5223 - protein, 275 aa, Artificial Sequence
  Synthetic Polypeptide encoding a CAR with optional accessory module(s)
MALPVTALLLPLALLLHAARPQVKLEESGGRLVQPRGSLRLSCAGSGRTFSTYGMAWFRQAPGKEREFVASKASMNYSGRTYYADSVKGRFTIARDNAKNMVFLQMNNLKPEDTAVYYCAAGTGCSTYGCFDAQIIDYWGKGTLVTVSSEVAALEKQVKLEESGGGLVQPGESLRLSCSASGSIFKVFRVFAMSWYRQGPGKQRELVASISSGETTTYADSVKGRFTISRDNAKNTAYLQMDSLKPEDTAVYYCNADHTFTGDFWGQGTQVTVSS

SEQ ID NO: 5224 - protein, 138 aa, Artificial Sequence
  Synthetic Polypeptide encoding a CAR with optional accessory module(s)
MALPVTALLLPLALLLHAARPQVKLEESGGELVQPGGPLRLSCAASGNIFSINRMGWYRQAPGKQRAFVASITVRGITNYADSVKGRFTISVDKSKNTIYLQMNALKPEDTAVYYCNAVSSNRDPDYWGQGTQVTVSS

SEQ ID NO: 5225 - protein, 150 aa, Artificial Sequence
  Synthetic Polypeptide encoding a CAR with optional accessory module(s)
MALPVTALLLPLALLLHAARPPVQLVESGGGLVQAGDSLRLSCAASGRTFGIGTMGWFRQPPGKEREFVAAIRWSTGGTRYADSVKGRFTISRDNAKLTVDLQMDSLKPEDTAVYYCAADRLSLDLSGRYHYNPAVYDYWGQGTQVTVSS

SEQ ID NO: 5226 - protein, 282 aa, Artificial Sequence
  Synthetic Polypeptide encoding a CAR with optional accessory module(s)
MALPVTALLLPLALLLHAARPQVKLEESGGELVQPGGPLRLSCAASGNIFSINRMGWYRQAPGKQRAFVASITVRGITNYADSVKGRFTISVDKSKNTIYLQMNALKPEDTAVYYCNAVSSNRDPDYWGQGTQVTVSSGGGGSGGGGSGGGGSPVQLVESGGGLVQAGDSLRLSCAASGRTFGIGTMGWFRQPPGKEREFVAAIRWSTGGTRYADSVKGRFTISRDNAKLTVDLQMDSLKPEDTAVYYCAADRLSLDLSGRYHYNPAVYDYWGQGTQVTVSS

SEQ ID NO: 5227 - protein, 140 aa, Artificial Sequence
  Synthetic Polypeptide encoding a CAR with optional accessory module(s)
MALPVTALLLPLALLLHAARPAVQLVESGGGLVQAGDSLRLTCTASGRAFSTYFMAWFRQAPGKEREFVAGIAWSGGSTAYADSVKGRFTISRDNAKNTVYLQMNSLKSEDTAVYYCASRGIEVEEFGAWGQGTQVTVSS

SEQ ID NO: 5228 - protein, 141 aa, Artificial Sequence
  Synthetic Polypeptide encoding a CAR with optional accessory module(s)
MALPVTALLLPLALLLHAARPQVQLVESGGGLVQAGGSLRLSCAASGGTLSKNTVAWFRQAPGKERGFVASITWDGRTTYYADSVKGRFTISRDNAKNTVYLQMNSLKPEDTAVYVCADLGKWPAGPADYWGQGTQVTVSS

SEQ ID NO: 5229 - protein, 267 aa, Artificial Sequence
  Synthetic Polypeptide encoding a CAR with optional accessory module(s)
MALPVTALLLPLALLLHAARPAVQLVESGGGLVQAGDSLRLTCTASGRAFSTYFMAWFRQAPGKEREFVAGIAWSGGSTAYADSVKGRFTISRDNAKNTVYLQMNSLKSEDTAVYYCASRGIEVEEFGAWGQGTQVTVSSPGGGGSPQVQLVESGGGLVQAGGSLRLSCAASGGTLSKNTVAWFRQAPGKERGFVASITWDGRTTYYADSVKGRFTISRDNAKNTVYLQMNSLKPEDTAVYVCADLGKWPAGPADYWGQGTQVTVSS

SEQ ID NO: 5230 - protein, 295 aa, Artificial Sequence
  Synthetic Polypeptide encoding a CAR with optional accessory module(s)
MALPVTALLLPLALLLHAARPAVQLVESGGGLVQAGDSLRLTCTASGRAFSTYFMAWFRQAPGKEREFVAGIAWSGGSTAYADSVKGRFTISRDNAKNTVYLQMNSLKSEDTAVYYCASRGIEVEEFGAWGQGTQVTVSSPGGGGSPQVQLVESGGGLVQAGGSLRLSCAASGGTLSKNTVAWFRQAPGKERGFVASITWDGRTTYYADSVKGRFTISRDNAKNTVYLQMNSLKPEDTAVYVCADLGKWPAGPADYWGQGTQVTVSSEVAALEKEVAALEKEVAALEKEVAALEK

SEQ ID NO: 5231 - protein, 724 aa, Artificial Sequence
  Synthetic Polypeptide encoding a CAR with optional accessory module(s)
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSRVEQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5232 - protein, 724 aa, Artificial Sequence
  Synthetic Polypeptide encoding a CAR with optional accessory module(s)
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5233 - protein, 724 aa, Artificial Sequence
  Synthetic Polypeptide encoding a CAR with optional accessory module(s)
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5234 - protein, 725 aa, Artificial Sequence
  Synthetic Polypeptide encoding a CAR with optional accessory module(s)
MALPVTALLLPLALLLHAARPDEIVLTQSPATLSLSPGERATLSCSASSSVSYMHWYQQKPGQAPRLLIYDTSKLASGIPARFSGSGSGTDFTLTISSLEPEDVAVYYCFQGSVYPFTFGQGTKLEIKRGGGGSGGGGSGGGGSQVQLQESGPGLVKPSQTLSLTCTVSGGSISTSGMGVGWIRQHPGKGLEWIGHIWWDDDKRYNPALKSRVTISVDTSKNQFSLKLSSVTAADTAVYYCARMELWSYYFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5235 - protein, 732 aa, Artificial Sequence
  Synthetic Polypeptide encoding a CAR with optional accessory module(s)
MALPVTALLLPLALLLHAARPDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5236 - protein, 731 aa, Artificial Sequence
  Synthetic Polypeptide encoding a CAR with optional accessory module(s)
MALPVTALLLPLALLLHAARPDIVMTQAAPSIPVTPGESVSISCRSSKSLLNSNGNTYLYWFLQRPGQSPQLLIYRMSNLASGVPDRFSGSGSGTAFTLRISRVEAEDVGVYYCMQHLEYPFTFGAGTKLELKRGGGGSGGGGSGGGGSEVQLQQSGPELIKPGASVKMSCKASGYTFTSYVMHWVKQKPGQGLEWIGYINPYNDGTKYNEKFKGKATLTSDKSSSTAYMELSSLTSEDSAVYYCARGTYYYGSRVFDYWGQGTTLTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5237 - protein, 729 aa, Artificial Sequence
  Synthetic Polypeptide encoding a CAR with optional accessory module(s)
MALPVTALLLPLALLLHAARPEIVLTQSPDFQSVTPKEKVTITCRASESVDTFGISFMNWFQQKPDQSPKLLIHAASNQGSGVPSRFSGSGSGTDFTLTINSLEAEDAATYYCQQSKEVPFTFGGGTKVEIKGGGGSGGGGSGGGGSEVQLVESGGGLVQPGGSLRLSCAASGFTFSSSWMNWVRQAPGKGLEWVGRIYPGDGDTNYNGKFKGRFTISRDDSKNSLYLQMNSLKTEDTAVYYCARSGFITTVLDFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5238 - protein, 725 aa, Artificial Sequence
  Synthetic Polypeptide encoding a CAR with optional accessory module(s)
MALPVTALLLPLALLLHAARPAIQLTQSPSSLSASVGDRVTITCRASQGISSAQQKPGKAPKLLILAWYSSLESGVPSRFSGYDASGSGTDFTLTISSLQPEDFATYYCQQFNSYPYTFGQGTKLEIKGGGGSGGGGSGGGGSEVQLVQSGAEVKKPGESLKISCKGSGYSFSSSWIGWVRQMPGKGLEWMGIIYPDDSDTRYSPSFQGQVTISADKSIRTAYLQWSSLKASDTAMYYCARHVTMIWGVIIDFWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5239 - protein, 749 aa, Artificial Sequence
  Synthetic Polypeptide encoding a CAR with optional accessory module(s)
MALPVTALLLPLALLLHAARPINIYNAEPANPSEKNSPEFDIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIKGGGGSGGGGSGGGGSEVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5240 - protein, 731 aa, Artificial Sequence
  Synthetic Polypeptide encoding a CAR with optional accessory module(s)
MALPVTALLLPLALLLHAARPDILLTQSPATLSLSPGERATLSCRASQSVDYDGDSYLNWYQQKPGQPPKLLIYDASNLVSGIPPRFSGSGSGTDFTLTISRLEPEDFAVYHCQQSTEDPWTFGGGTKLEIKGGGGSGGGGSGGGGSQVQLVESGGGLVEPGGSLRLSCMSGYAFSSYWMNWVRQMPGKGLEWMGQIWPGDGDTNYNPSLKSRVTITADESTSTAYMELSSLKAEDTAVYFCARRETTTVGRYYYAMDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5241 - protein, 728 aa, Artificial Sequence
  Synthetic Polypeptide encoding a CAR with optional accessory module(s)
MALPVTALLLPLALLLHAARPDILLTQSPATLSLSPGERATLSCRASQSVDNYGISFMNWYQQKPGQPPKLLIYAASNQGSGIPSRFSGSGSGTDFTLTISSLEPEDFAMYFCQQSNEVPRTFGGGTKLEIKGGGGSGGGGSGGGGSQVQLVESGGGLVEPGGSLRLSCMSGYAFSSSWMNWVRQMPGKGLEWMGRIYPGDGDTNYNGKFKERVTITADESTSTAYMELSSLKAEDTAVYFCARSEYWGNYWAMDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5242 - protein, 727 aa, Artificial Sequence
  Synthetic Polypeptide encoding a CAR with optional accessory module(s)
MALPVTALLLPLALLLHAARPDILLTQSPATLSLSPGERATLSCKASQNVGTNVAWYQQKPGQPPKLLIYSATYRNSGIPARFSGSGSGTEFTLTITNVQSKDLADYFYFCQYNRYPYTSGGGTKLEIKRGGGGSGGGGSGGGGSQVQLVESGGGLVEPGGSLRLSCMSGYAFSSYWMNWVRQMPGKGLEWMGQIYPGDGDTNYNGKFKGRVTITADESTSTAYMELSSLKAEDTAVYFCARKTISSVVDFYFDNWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5243 - protein, 740 aa, Artificial Sequence
  Synthetic Polypeptide encoding a CAR with optional accessory module(s)
MALPVTALLLPLALLLHAARPINIYNAEPANPSEKNSPEFQIVLTQSPATLSASPGEKATMTCSASSGVNYMHWYQQKPGTSPKRWIYDTDKTASGVPARFSGSGSGTSYSLTISSMEAEDAATYYCHQRGSYTFGGGTKLEIKGGGGSGGGGSGGGGSQVQLEQPGAEVVKPGASVKVSCKTSGYTFTSNWMHWVKQTPGKGLEWIGEIDPSDSYTNYNQKFDGKAKLTVDKSSSTAYMEVSDLTAEDSATYYCARGSNPYYYAMDYWGQGTSVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5244 - protein, 726 aa, Artificial Sequence
  Synthetic Polypeptide encoding a CAR with optional accessory module(s)
MALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRGGGGSGGGGSGGGGSQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5245 - protein, 734 aa, Artificial Sequence
  Synthetic Polypeptide encoding a CAR with optional accessory module(s)
MALPVTALLLPLALLLHAARPDDIQLTQSPSSLSASVGDRVTITCKASQSVDYDGDSYLNWYQQIPGKAPKLLIYDASNLVSGIPPRFSGSGSGTDYTFTISSLQPEDIATYHCQQSTEDPWTFGGGTKLQIKRGGGGSGGGGSGGGGSQVQLQQSGAEVKKPGSSVKVSCKASGYAFSSYWMNWVRQRPGQGLEWIGQIWPGDGDTNYNGKFKGRATITADESTNTAYMELSSLRSEDTAFYSCARRETTTVGRYYYAMDYWGQGTTVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5246 - protein, 725 aa, Artificial Sequence
  Synthetic Polypeptide encoding a CAR with optional accessory module(s)
MALPVTALLLPLALLLHAARPQSVLTQPASVSGSPGQSITISCTGTSSDVGGYNYVSWYQQHPGKAPKLMIYDVNNRPSEVSNRFSGSKSGNTASLTISGLQAEDEADYYCSSYTTGSRAVFGGGTKLTVLGGGGGSGGGGSGGGGSEVQLVQSGAEVKKPGESLTISCKASGYSFPNYWITWVRQMSGGGLEWMGRIDPGDSYTTYNPSFQGHVTISIDKSTNTAYLHWNSLKASDTAMYYCARYYVSLVDIWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5247 - protein, 731 aa, Artificial Sequence
  Synthetic Polypeptide encoding a CAR with optional accessory module(s)
MALPVTALLLPLALLLHAARPQSVVTQPPSVSAAPGQKVTISCSGSSSNIGNNYVSWYQQLPGTAPKLLIYDNNKRPSGIPDRFSGSKSGTSATLGITGLQTGDEADYYCGTWDGSLYTMLFGGGTKLTVLGGGGSGGGGSGGGGSEVQLVESGGGLVKPGGSLRLSCAASGFTFSNAWMSWVRQAPGKGLEWVGFIRSKAYGGTTEYAASVKGRFTISRDDSKSIAYLQMNNLKTEDTAVYYCARDGLYSSSWYDSDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5248 - protein, 736 aa, Artificial Sequence
  Synthetic Polypeptide encoding a CAR with optional accessory module(s)
MALPVTALLLPLALLLHAARPQSVLTQPPSVSGAPGQRVTISCTGSSSNIGAGYDVHWYQQLPGTAPKLLIFGNSNRPSGVPDRFSGFKSGTSASLAITGLQAEDEADYFCQSYDSSLSGSGVFGTGTKVTVLGGGGGSGGGGSGGGGSQMQLVQSGGGLVQPGRSLRLSCAASGFTFDDYAMHWVRQAPGKGLEWVSGISWNSGSIGYADSVKGRFTISRDNAKNSLYLQMNSLRAEDTALYYCAKDIHSGSYYGLLYYAMDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5249 - protein, 723 aa, Artificial Sequence
  Synthetic Polypeptide encoding a CAR with optional accessory module(s)
MALPVTALLLPLALLLHAARPDYIHVTQSPSSLSVSIGDRVTINCQTSQGVGSDLHWYQHKPGRAPKLLIHHASSVEDGVPSRFSGTGFHTSFNLTINDLQADDIGTYYCQVLQSFGRGSRLDTKGGGGSGGGGSGGGGSRAHLVQSGTAMKKPGASVRVSCQTSGYTFTAHILFWFRQAPGRGLEWVGWIKPQYGAVNFGGGFRDRVTLTRDVYREIAYMDIRGLKPDDTAVYYCARDRSYGDSSWALDAWGQGTTVVVSATREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5250 - protein, 733 aa, Artificial Sequence
  Synthetic Polypeptide encoding a CAR with optional accessory module(s)
MALPVTALLLPLALLLHAARPDVQMIQTPDSLAVSLGQRATISCRASESVDNYGISFMHWYQQKPGQSPKLLIYRASNLESGIPARFSGSGSRTDFTLTINPVETDDVATYYCQQNNKDPPTFGGGTKLEIKGGGGSGGGGSGGGGSGGGGSQVQLQQSGAELVKPGASVKISCKASGYAFSSYWMNWVKQRPGKGLEWIGQIYPGDGDTTYNGKFKGKATLTADKSSSTVYMQLNSLTSEDSAVYFCVRYYYGSSGYFDYWGQGTTLTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5251 - protein, 724 aa, Artificial Sequence
  Synthetic Polypeptide encoding a CAR with optional accessory module(s)
MALPVTALLLPLALLLHAARPDVQMIQTPSSLSASLGDRVTISCRASQDIGNYLNWYQQKPDGTVKLLIYYTSRLHSGVPSRFSGSGSGTEYSLTISNLEQEDIATYFCQQGSALPPTFGGGTKLEINGGGGSGGGGSGGGGSALQLQQSGAELVRPGASVTLSCKASGYTFTDYEMHWVKQTPVHGLEWIGAIDPETGGTAYNQKFEGKAILTADKSSSTAYMELRSLTSEDSPVYYCARRRYYGSSSFDYWGQGTTLTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5252 - protein, 731 aa, Artificial Sequence
  Synthetic Polypeptide encoding a CAR with optional accessory module(s)
MRLPAQLLGLLMLWVSGSSGDVVMTQSPLSLPVTPGAPASISCRSSQSIVHSNGNTYLEWYLQKPGQSPKLLIYKVSNRFSGVPDRFSGSGSGTDFTLRISRVEAEDVGIYYCFQGSHVPPTFGPGTKLEIKGGGGSGGGGSGGGGSEVQLVESGGGLVQPGGSLRLSCSASGFTFSSFGMHWVRQAPGKGLEWVAYISSGSSTIYYGDTVKGRFTISRDNAKNSLFLQMSSLRAEDTAVYYCAREGGYYYGRSYYTMDYWGQGTTVTVSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5253 - protein, 756 aa, Artificial Sequence
  Synthetic Polypeptide encoding a CAR with optional accessory module(s)
MALPVTALLLPLALLLHAARPARKRTQPTFGFTVNWKFSESTTVFTGQCFIDRNGKEVLKTMWLLRSSVNDIGDDWKATRVGINIFTRLRTQKEGGSGGSARKCSLTGKWTNDLGSNMTIGAVNSRGEFTGTYITAVTATSNEIKESPLHGTQNTINKSGGSTTVFTGQCFIDRNGKEVLKTMWLLRSSVNDIGDDWKATRVGINIFTRLRTQKEGGSGGSARKCSLTGKWTNDLGSNMTIGAVNSRGEFTGTYITAVTATSNEIKESPLHGTQNTINKRTQPTFGFTVNWKFSETREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5254 - protein, 728 aa, Artificial Sequence
  Synthetic Polypeptide encoding a CAR with optional accessory module(s)
MALPVTALLLPLALLLHAARPDIVLTQSPASLAVSLGQRATISCRASKSVSTSGYSYLHWYQQKPGQPPKLLIYLASNLESGVPARFSGSGSGTDFTLNIHPVEEEDAATYYCQHSRELPFTFGSGTKLEIKGGGGSGGGGSGGGGSQVQLVESGGGLVQPGGSLKLSCAASGFDFSRYWMSWVRQAPGKGLEWIGEINPTSSTINFTPSLKDKVFISRDNAKNTLYLQMSKVRSEDTALYYCARGNYYRYGDAMDYWGQGTSVTVSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5255 - protein, 726 aa, Artificial Sequence
  Synthetic Polypeptide encoding a CAR with optional accessory module(s)
MALPVTALLLPLALLLHAARPDIQMTQSPSSLSASVGDRVTITCSASQDISNYLNWYQQKPGKAPKLLIYYTSNLHSGVPSRFSGSGSGTDFTLTISSLQPEDFATYYCQQYRKLPWTFGQGTKLEIKRGGGGSGGGGSGGGGSQVQLVQSGAEVKKPGSSVKVSCKASGGTFSNYWMHWVRQAPGQGLEWMGATYRGHSDTYYNQKFKGRVTITADKSTSTAYMELSSLRSEDTAVYYCARGAIYDGYDVLDNWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5256 - protein, 726 aa, Artificial Sequence
  Synthetic Polypeptide encoding a CAR with optional accessory module(s)
MALPVTALLLPLALLLHAARPDIVLTQSPATLSLSPGDRATISCRASESVTILGSHLIYWYQQKPGQPPRLLIQLASNVQTGVPARFSGSGSRTDFTLTISSVEPEDFAVYYCLQSRTIPRTFGQGTKLEIKRGGGGSGGGGSGGGGSQVQLVQSGPEVKKPGESVKISCKASGYTFRHYSMNWVKQAPGQGLKWMGRINTESGVPIYADDFKGRFSFTVDTSASTAYLEISSLTSEDTAVYFCSNDYLYSLDFWGQGTTLTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5257 - protein, 727 aa, Artificial Sequence
  Synthetic Polypeptide encoding a CAR with optional accessory module(s)
MALPVTALLLPLALLLHAARPQSVLTQPPSVSGAPGQRVTISCTGSSSNIGAGFDVHWYQQLPGTAPKLLIYGNSNRPSGVPDRFSGSKSGTSASLAITGLQAEDEADYYCQSYDSSLSGYVFGTGTKVTVLGGGGGSGGGGSGGGGSQVQLVQSGAEVKKPGASVKVSCKASGYTFTDYYMHWVRQAPGQRLEWMGWINPNSGGTNYAQKFQDRITVTRDTSSNTGYMELTRLRSDDTAVYYCARSPYSGVLDKWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5258 - protein, 725 aa, Artificial Sequence
  Synthetic Polypeptide encoding a CAR with optional accessory module(s)
MALPVTALLLPLALLLHAARPQAVLTQPPSASGTPGQRVTISCSGSSSNIGSYTVSWYQQLPGTAPKFLIYSNNQRPSGVPDRFSGSKSGTSASLAISGLQSEDEADYYCAAWDDSLNGYVFGTGTKVTVLGGGGGSGGGGSGGGGSEVQLVQSGAEVKKPGESLKISCKGSGYDFTTYWIGWVRQMPGKGLEWMGIIYPGDSDTRYSPSVRGRVTISADKSINTAYLQWSSLEASDTAMYYCARMWTFSQDGWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5259 - protein, 736 aa, Artificial Sequence
  Synthetic Polypeptide encoding a CAR with optional accessory module(s)
MALPVTALLLPLALLLHAARPLPVLTQPPSASGTPGQRVTISCSGRSSNIGSNSVNWYRQLPGAAPKLLIYSNNQRPPGVPVRFSGSKSGTSASLAISGLQSEDEATYYCATWDDNLNVHYVFGTGTKVTVLGSRGGGGSGGGGSGGGGSLEMAQVQLVQSGAEVKKPGSSVKVSCKASGGTFSSYAISWVRQAPGQGLEWMGRIIPILGIANYAQKFQGRVTITADKSTSTAYMELSSLRSEDTAVYYCARGGYYSHDMWSEDWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5260 - protein, 725 aa, Artificial Sequence
  Synthetic Polypeptide encoding a CAR with optional accessory module(s)
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRIFPRTFGQGTKLEIKGGGGSGGGGSGGGGSQVQLVQSGSELKKPGESVKISCKASGYTFTDYSINWVKQAPGQGLKWMGWINTETREPAYAYDFRGRFVFSLDTSASTAYLQISSLKAEDTAVYFCALDYSYAMDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5261 - protein, 726 aa, Artificial Sequence
  Synthetic Polypeptide encoding a CAR with optional accessory module(s)
MALPVTALLLPLALLLHAARPDIVLTQSPATLSLSPGDRATLSCRASESVTILGSHLIYWYQQKPGQAPRLLIQLASNVQTGIPARFSGSGSRTDFTLTISSLEPEDFAVYYCLQSRTIPRTFGQGTKLEIKRGGGGSGGGGSGGGGSQVQLVQSGSELKKPGESVKISCKASGYTFTHYSMNWVRQAPGQGLEWMGRINTETGEPLYADDFKGRFVFSLDTSASTAYLQISSLKAEDTAVYYCSNDYLYSLDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5262 - protein, 727 aa, Artificial Sequence
  Synthetic Polypeptide encoding a CAR with optional accessory module(s)
MALPVTALLLPLALLLHAARPDIVMTQSPDSLAVSLGERATINCKSSQSILYSSNQKNYLAWYQQKPGQSPKLLIYWASTRESGVPDRFSGSGSGTDFTLTISSLQAEDVAVYYCHQYISSYTFGQGTKLEIKGGGGSGGGGSGGGGSQVQLVQSGAEVKKPGASVKVSCKASGYTFASQWMHWMRQAPGQGLEWIGWINPGNVNTKYNEKFKGRATLTVDTSTNTAYMELSSLRSEDTAVYYCARSTWYRPLDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5263 - protein, 851 aa, Artificial Sequence
  Synthetic Polypeptide encoding a CAR with optional accessory module(s)
MVRGVPFRHLLLVLQLALLPAATQGKKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASGGGGSGGGGSGGGGSIYQELTQLKAAVERLCHPCPWEWTFFQGNCYFMSNSQRNWHDSITACKEVGAQLVVIKSAEEQNFLQLQSSRSNRFTWMGLSDLNQEGTWQWVDGSPLLPSFKQYWNRGEPNNVGEEDCAEFSGNGWNDDKCNLAKFWICKKSAASCSRDEEQFLSPAPATPNPPPATREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5264 - protein, 727 aa, Artificial Sequence
  Synthetic Polypeptide encoding a CAR with optional accessory module(s)
MALPVTALLLPLALLLHAARPDHIVLTQSPSSLSASLGDRVTISCRASQDISTYLNWYQQKPDGTVKLLIFYTSRLHAGVPSRFSGSGSGTHHSLTISNLEQEDIATYFCQQGNSLPFTFGSGTKLEIKRGGGGSGGGGSGGGGSQVQLKESGPELEKPGASVKISCKASGYSFTAYSMNWVKQNNGMSLEWIGSIDPYYGDTKYAQKFKGKATLTVDKASSTAYLQLKSLTSEDSAVYYCARRMITTGDWYFDVWGAGTTVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5265 - protein, 727 aa, Artificial Sequence; identical to SEQ ID NO: 5264
  Synthetic Polypeptide encoding a CAR with optional accessory module(s)

SEQ ID NO: 5266 - protein, 674 aa, Artificial Sequence
  Synthetic Polypeptide encoding a CAR with optional accessory module(s)
MALPVTALLLPLALLLHAARPGMRTEDLPKAVVFLEPQWYRVLEKDSVTLKCQGAYSPEDNSTQWFHNESLISSQASSYFIDAATVDDSGEYRCQTNLSTLSDPVQLEVHIGWLLLQAPRWVFKEEDPIHLRCHSWKNTALHKVTYLQNGKGRKYFHHNSDFYIPKATLKDSGSYFCRGLVGSKNVSSETVNITITQGLAVSTISSFFPPGYQTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5267 - protein, 674 aa, Artificial Sequence; identical to SEQ ID NO: 5266
  Synthetic Polypeptide encoding a CAR with optional accessory module(s)

SEQ ID NO: 5268 - protein, 727 aa, Artificial Sequence
  Synthetic Polypeptide encoding a CAR with optional accessory module(s)
MALPVTALLLPLALLLHAARPDEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKGGGGSGGGGSGGGGSEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5269 - protein, 729 aa, Artificial Sequence
  Synthetic Polypeptide encoding a CAR with optional accessory module(s)
MALPVTALLLPLALLLHAARPDIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKRGGGGSGGGGSGGGGSQVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5270 - protein, 726 aa, Artificial Sequence
  Synthetic Polypeptide encoding a CAR with optional accessory module(s)
MALPVTALLLPLALLLHAARPDIVLTQSPAIITASPGEKVTMTCRASSSVNYMDWYQKKPGSSPKPWIYATSNLASGVPSRFSGSGSGTTYSMTISSLEAEDAATYYCQQWSFNPPTFGGGTKLEIKRGGGGSGGGGSGGGGSEVQLQQSGAELKKPGASVKVSCKASGYTFTSYNMHWVKQTPGQGLEWIGAIYPGNGDTSYNQKFKGKTTLTADKSSSTAYMELSSLRSEDTAVYYCARSNYYGSSYWFFDVWGTGTTVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5271 - protein, 729 aa, Artificial Sequence
  Synthetic Polypeptide encoding a CAR with optional accessory module(s)
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSDWPLTFGGGTKVEIKGGGGSGGGGSGGGGSEVQLVQSGGGLVHPGGSLRLSCTGSGFTFSYHAMHWVRQAPGKGLEWVSIIGTGGVTYYADSVKGRFTISRDNVKNSLYLQMNSLRAEDMAVYYCARDYYGAGSFYDGLYGMDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5272 - protein, 727 aa, Artificial Sequence
  Synthetic Polypeptide encoding a CAR with optional accessory module(s)
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGGGTKVEIKGGGGSGGGGSGGGGSAVQLVESGGGLVQPGRSLRLSCAASGFTFGDYTMHWVRQAPGKGLEWVSGISWNSGSIGYADSVKGRFTISRDNAKNSLYLQMNSLRAEDTALYYCTKDNQYGSGSTYGLGVWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5273 - protein, 726 aa, Artificial Sequence
  Synthetic Polypeptide encoding a CAR with optional accessory module(s)
MALPVTALLLPLALLLHAARPDIQMTQSPSSLSASVGDRVTITCRASSSVSYMHWYQQKPGKAPKPLIYAPSNLASGVPSRFSGSGSGTDFTLTISSLQPEDFATYYCQQWSFNPPTFGQGTKVEIKRGGGGSGGGGSGGGGSEVQLVESGGGLVQPGGSLRLSCAASGYTFTSYNMHWVRQAPGKGLEWVGAIYPGNGDTSYNQKFKGRFTISVDKSKNTLYLQMNSLRAEDTAVYYCARVVYYSNSYWYFDVWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5274 - protein, 724 aa, Artificial Sequence
  Synthetic Polypeptide encoding a CAR with optional accessory module(s)
MALPVTALLLPLALLLHAARPDIQLTQSPSSLSASVGDRVTMTCRASSSVSYIHWFQQKPGKAPKPWIYATSNLASGVPVRFSGSGSGTDYTFTISSLQPEDIATYYCQQWTSNPPTFGGGTKLEIKGGGGSGGGGSGGGGSQVQLQQSGAEVKKPGSSVKVSCKASGYTFTSYNMHWVKQAPGQGLEWIGAIYPGNGDTSYNQKFKGKATLTADESTNTAYMELSSLRSEDTAFYYCARSTYYGGDWYFDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5275 - protein, 736 aa, Artificial Sequence
  Synthetic Polypeptide encoding a CAR with optional accessory module(s)
MALPVTALLLPLALLLHAARPSTVMTQSPDSLAVSLGERATINCKSSQSNSNDVAWYQQKPGQSPKVLIYFASNRYSGVPDRFSGSGYGTDFTLTISSLQAEDVAVYFCQQDYSSPLTFGAGTKLELKRADAGGGGSGGGGSGGGGSQIQLVQSGSELKKPGASVKVSCKASGYTFTNFGVNWVRQAPGKGLEWMGWINTYTGEPSYAQGFTGRFVFSLDASVSTAYLQISSLKAEDTATYFCTRRTNYYGTSYYYAMDYWGQGTTVTVSSAKTTTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5276 - protein, 728 aa, Artificial Sequence
  Synthetic Polypeptide encoding a CAR with optional accessory module(s)
MALPVTALLLPLALLLHAARPQIVLSQSPAILSASPGEKVTMTCRASSSVSYMHWYQQKPGSSPKPWIYATSNLASGVPARFSGSGSGTSYSFTISRVEAEDAATYYCQQWTFNPPTFGGGTRLEIKRTVAAGGGGSGGGGSGGGGSQAYLQQSGAELVRPGASVKMSCKASGYTFTSYNMHWVKQTPRQGLEWIGGIYPGNGDTSYNQKFKGKATLTVGKSSSTAYMQLSSLTSEDSAVYFCARYDYNYAMDYWGQGTSVTVSSASTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5277 - protein, 726 aa, Artificial Sequence; identical to SEQ ID NO: 5273
  Synthetic Polypeptide encoding a CAR with optional accessory module(s)

SEQ ID NO: 5278 - protein, 725 aa, Artificial Sequence
  Synthetic Polypeptide encoding a CAR with optional accessory module(s)
MALPVTALLLPLALLLHAARPEIVLTQSPSSLSASVGDRVTITCRASSSLSFMHWYQQKPGKAPKPWIYATSNLASGVPSRFSGSGSGTDYTLTISSLQPEDFATYFCHQWSSNPLTFGGGTKVEIKGGGGSGGGGSGGGGSQVQLVQSGAEVKKPGASVKVSCKASGYTFTSYNMHWVRQAPGQRLEWIGAIYPGNGDTSYNQKFKGRVTVTRDTSANTAYMELSSLKSEDTAVYYCARSHYGSNYVDYFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5279 - protein, 727 aa, Artificial Sequence
  Synthetic Polypeptide encoding a CAR with optional accessory module(s)
MALPVTALLLPLALLLHAARPDEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKGGGGSGGGGSGGGGSEVQLVESGGGLVQPDRSLRLSCAASGFTFHDYAMHWVRQAPGKGLEWVSTISWNSGTIGYADSVKGRFTISRDNAKNSLYLQMNSLRAEDTALYYCAKDIQYGNYYYGMDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5280 - protein, 725 aa, Artificial Sequence
  Synthetic Polypeptide encoding a CAR with optional accessory module(s)
MALPVTALLLPLALLLHAARPEIVLTQSPGTLSLSPGERATLSCRASSSVPYIHWYQQKPGQAPRLLIYATSALASGIPDRFSGSGSGTDFTLTISRLEPEDFAVYYCQQWLSNPPTFGQGTKLELKRGGGGSGGGGSGGGGSEVQLVQSGAEVKKPGESLKLSCKGSGRTFTSYNMHWVRQMPGKGLEWMGAIYPLTGDTSYNQKSKLQVTISADKSISTAYLQWSSLKASDTAMYYCARSTYVGGDWQFDVWGKGTTVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5281 - protein, 730 aa, Artificial Sequence
  Synthetic Polypeptide encoding a CAR with optional accessory module(s)
MALPVTALLLPLALLLHAARPDIQMTQSPSSLSASVGDRVTITCRSSQSIVHSVGNTFLEWYQQKPGKAPKLLIYKVSNRFSGVPSRFSGSGSGTDFTLTISSLQPEDFATYYCFQGSQFPYTFGQGTKVEIKRGGGGSGGGGSGGGGSEVQLVESGGGLVQPGGSLRLSCAASGYEFSRSWMNWVRQAPGKGLEWVGRIYPGDGDTNYSGKFKGRFTISADTSKNTAYLQMNSLRAEDTAVYYCARDGSSWDWYFDVWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5282 - protein, 722 aa, Artificial Sequence
  Synthetic Polypeptide encoding a CAR with optional accessory module(s)
MALPVTALLLPLALLLHAARPDIVMTQSPSSLSASVGDRVTITCKASQSVTNDVAWYQQKPGKAPKLLIYYASNRYTGVPSRFSGSGSGTDFTLTISSLQPEDFATYYCQQDYRSPWTFGGGTKVEIKRGGGGSGGGGSGGGGSQVQLEESGGGVVRPGRSLRLSCAASGFTFSDYGVNWIRQAPGKGLEWVTIIWGDGRTDYNSALKSRFTVSRNNSNNTLSLQMNSLTTEDTAVYYCVRAPGNRAMEYWGQGVLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5283 - protein, 728 aa, Artificial Sequence
  Synthetic Polypeptide encoding a CAR with optional accessory module(s)
MALPVTALLLPLALLLHAARPDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQIFGQGTKLEIKGGGGSGGGGSGGGGSQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5284 - protein, 728 aa, Artificial Sequence
  Synthetic Polypeptide encoding a CAR with optional accessory module(s)
MALPVTALLLPLALLLHAARPQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSGGGGSGGGGSGGGGSDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQIFGQGTKLEIKTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5285 - protein, 721 aa, Artificial Sequence
  Synthetic Polypeptide encoding a CAR with optional accessory module(s)
MALPVTALLLPLALLLHAARPDIQMTQSPATIENTSLSASVGDRVTITCRASQGISSWLTWYQQKPEKAPKSLIYAASSLQSGVPSRFSGSGSGTDFTLTISSLQPEDFATYYCQQYDSYPITFGQGTRLEIKGGGGSGGGGSGGGGSQVQLQQWGAGLLKPSETLSLTCAVYGGSFSAYYWSWIRQPPGKGLEWIGDINHGGGTNYNPSLKSRVTISVDTSKNQFSLKLNSVTAADTAVYYCASLTAYWGQGSLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5286 - protein, 726 aa, Artificial Sequence
  Synthetic Polypeptide encoding a CAR with optional accessory module(s)
MALPVTALLLPLALLLHAARPDEIVLTQSPDSLAVSLGERATINCKASQSVDFDGDSYLNWYQQKPGQPPKVLIYAASTLQSGVPSRFSGSGSGTDFTLTINSLEAEDAATYYCQQSNEDPWTFGGGTKVEIKGGGGSGGGGSGGGGSQVQLVQSGAEVKKPGASVKVSCKVSGYTFTDYYITWVRQAPGQALEWMGWIYPGSGNTKYSQKFQGRFVFSVDTSASTAYLQLSSLKAEDTAVYYCANYGNYWFAYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5287 - protein, 723 aa, Artificial Sequence
  Synthetic Polypeptide encoding a CAR with optional accessory module(s)
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKGGGGSGGGGSGGGGSEVQLVQSGGGLVHPGGSLRLSCAGSGFAFSSSTMHWIRQAPGKGLEWISLIGSGGGIYYGDSVKGRFTISRDNAKNSLYLQMNSLRAEDMAVYYCVRGYFDWVDYFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5288 - protein, 733 aa, Artificial Sequence
  Synthetic Polypeptide encoding a CAR with optional accessory module(s)
MALPVTALLLPLALLLHAARPDDIVMTQSPDSLTVSLGERTTINCKSSQSVLDSSKNKNSLAWYQQKPGQPPKLLLSWASTRESGIPDRFSGSGSGTDFTLTIDSLQPEDSATYYCQQSAHFPITFGQGTRLEIKGGGGSGGGGSGGGGSQVQLVQSGAEVKKPGASVKVSCKASGYTFTNYGMNWVKQAPGQGLKWMGWINTYTGEPTYADDFKGRVTMTSDTSTSTAYLELHNLRSDDTAVYYCARWSWSDGYYVYFDYWGQGTTVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5289 - protein, 729 aa, Artificial Sequence
  Synthetic Polypeptide encoding a CAR with optional accessory module(s)
MALPVTALLLPLALLLHAARPDEIVLTQSPGSLAVSPGERVTMSCKSSQSVFFSSSQKNYLAWYQQIPGQSPRLLIYWASTRESGVPDRFTGSGSGTDFTLTISSVQPEDLAIYYCHQYLSSRTFGQGTKLEIKRGGGGSGGGGSGGGGSQVQLQQPGAEVVKPGASVKMSCKASGYTFTSYYIHWIKQTPGQGLEWVGVIYPGNDDISYNQKFQGKATLTADKSSTTAYMQLSSLTSEDSAVYYCAREVRLRYFDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5290 - protein, 755 aa, Artificial Sequence
  Synthetic Polypeptide encoding a CAR with optional accessory module(s)
MALPVTALLLPLALLLHAARPYINIYNAEPANPSEKNSPTQYAYGSGEFDIQLTQSPSSLSASVGDRVTITCRASQGISSVLAWYQQKPGKAPKLLIYDASSLESGVPSRFSGSGSGTDFTLTISSLQPEDFATYYCQQFNSSITFGQGTKLEIKRTVAAGGGGSGGGGSGGGGSQVQLVQSGAEVKKPGSSVKVSCKASGGTFSDYAISWVRQAPGQGLEWMGRIIPILGVANYAQKFQGRVTITADKSTRTAYMELSSLRSEDTAVYYCARNWADAFDIWGQGTMVTVSSASTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5291 - protein, 754 aa, Artificial Sequence
  Synthetic Polypeptide encoding a CAR with optional accessory module(s)
MALPVTALLLPLALLLHAARPYINIYNAEPANPSEKNSPTQYAYGSGEFDIVMTQSPSSLSASLGGKVTITCKASQDINKYIAWYQHKPGKGPRLLIHYTSTLQPGIPSRFSGSGSGRDYSFSISNLEPEDIATYYCLQYDNLLTFGAGTKLELKRGGGGSGGGGSGGGGSEVKLQQSGPELVKPGTSVKVSCKASGYSFTDYNMYWVKQSHGKSLEWIGYIDPYKGGTIYNQKFKGKATLTVDKSSSTAFMHLNSLTSEDSAVYYCAREMITAYYFDYWGQGSSVTVSSLERTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5292 - protein, 770 aa, Artificial Sequence
  Synthetic Polypeptide encoding a CAR with optional accessory module(s)
MALPVTALLLPLALLLHAARPDIQMTQSPSSLSASVGDRVTINCKASQDINSYLSWFQQKPGKAPKTLIYRANRLVDGVPSRFSGSGSGQDYTLTISSLQPEDFATYYCLQYDEFPLTFGGGTKVEIKGGGGSGGGGSGGGGSQVQLVQSGAEVKKPGASVKVSCKASGYTFTNYDINWVRQAPGQGLEWIGWIYPGDGSTKYNEKFKAKATLTADTSTSTAYMELRSLRSDDTAVYYCASGYEDAMDYWGQGTTVTVSSAKPTTTPAPRPPTPAPTIASQPLSLRPEACRPAAGGAVHTRGLDFACDITREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5293 - protein, 726 aa, Artificial Sequence
  Synthetic Polypeptide encoding a CAR with optional accessory module(s)
MALPVTALLLPLALLLHAARPEIVLTQSPLSLPVTPGEPASISCRSSQSLLHSNGYNYLDWYLQKPGQSPQLLIYLGVNSVSGVPDRFSGSGSGTDFTLKISRVEAEDVGVYYCMQALQTPWTFGQGTKVEIKGGGGSGGGGSGGGGSQVQLVQSGAEVKKPGSSVKVSCKASGGIFSNHAISWVRQAPGQGLEWMGGIIPIFGTANYAQKFQGRVTITADESTSTAFMELSSLRSEDTAVYYCAREWADVFDIWGQGTMVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5294 - protein, 725 aa, Artificial Sequence
  Synthetic Polypeptide encoding a CAR with optional accessory module(s)
MALPVTALLLPLALLLHAARPDIQMTQSPASLTVSLGQRATISCRASESVDSYGNSYLHWYQQKPGQPPQLLIYLASNLESGVPARFSGSGSRTDFTLTIDPVEADDAATYYCQQNNEDPWTFGGGTKVEIKGGGGSGGGGSGGGGSEVQLQQSGAELVKPGASVKMSCKAFGYTFTTFPIEWMKQSHGKSLEWIGNFHPYNDQTKYNEEFKGRAKLTIDRSSSTVYLELGRLTSDDSAVYYCARGYYYAFDFWGQGTTLTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5295 - protein, 722 aa, Artificial Sequence
  Synthetic Polypeptide encoding a CAR with optional accessory module(s)
MALPVTALLLPLALLLHAARPDIQMTQSPSSLSASVGDRVTITCRASQGIRNDLGWYQQKPGKAPKRLIYAASSLQSGVPSRFSGSGSGTEFTLTISSLQPEDFATYYCLQHNSYPWTFGQGTKLEIKGGGGSGGGGSGGGGSEVQLVESGGALIQPGGSLRLSCVASGFTISGNYMSWVRQAPGKGLEWVSLIYSGDSTYYADSVKGRFTISRDISKNTVYLQMNSLRVEDTAVYYCVRDGYYVSDMVVWGKGTTVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5296 - protein, 732 aa, Artificial Sequence
  Synthetic Polypeptide encoding a CAR with optional accessory module(s)
MALPVTALLLPLALLLHAARPDVLLTQSPLSLPVTLGQPASISCRSSQTIVHSNGNTYLEWFQQRPGQSPRLLIYQVSNRFSGVPDRFSGSGSGTDFTLKISRVEAEDVGVYYCFQGSHVPRTFGGGTKVEIKRGGGGSGGGGSGGGGSQIQLVQSGSELKKPGASVKVSCKASGYTFTNYGMNWVRQAPGQGLKWMGWINTNTGEPKYAEEFKGRFALSLDTSVSTAYLQINSLKAEDTAVYFCARGYGNYARGAWLAYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5297 - protein, 719 aa, Artificial Sequence
  Synthetic Polypeptide encoding a CAR with optional accessory module(s)
MALPVTALLLPLALLLHAARPDEIVLTQSPATLSLSPGERATLSCSASSSINYIYWLQQKPGQAPRILIYLTSNLASGVPARFSGSGSGTDFTLTISSLEPEDFAVYYCLQWSSNPLTFGGGTKVEIKGGGGSGGGGSGGGGSFEVQLVESGGGLVKPGGSLRLSCAASGFTFSSYDMSWVRQAPGKGLEWVSTISSGGSYTYYLDSIKGRFTISRDNAKNSLYLQMNSLRAEDTAVYYCARQGLDYWGRGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5298 - protein, 727 aa, Artificial Sequence
  Synthetic Polypeptide encoding a CAR with optional accessory module(s)
MALPVTALLLPLALLLHAARPDIVMTQSPDSLAVSLGERATINCRASKSVSTSGYSFMHWYQQKPGQPPKLLIYLASNLESGVPDRFSGSGSGTDFTLTISSLQAEDVAVYYCQHSREVPWTFGQGTKVEIKRGGGGSGGGGSGGGGSQVQLVQSGAEVKKPGASVKVSCKASGYTFTNYGMNWVRQAPGQGLEWMGWINTYTGEPTYADAFKGRFAFSLDTSTSTAYLQINSLRSDDTAVYYCARDYGDYGMDYWGQGTTVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5299 - protein, 723 aa, Artificial Sequence
  Synthetic Polypeptide encoding a CAR with optional accessory module(s)
MALPVTALLLPLALLLHAARPDIVMTQTPLTLSVTIGQPASISCKSSQSLLDSDGKTYLNWLLQRPGQSPERLIYLVSKLDSGVPDRFTGSGSGTDFTLKISRVEAEDLGVYCCWQGTHFPYTFGGGTKVEIKGGGGGSGGGGSGGGGSQVQLQQPGAELVRPGASVKLSCKASGYTFTSYWMNWVKQRPGQGLEWIGMIDPSDSETHYNHIFKDKATLTVDKSSSTAYLQLSSLTSEDSAVYYCARNLYLWGQGTSVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5300 - protein, 727 aa, Artificial Sequence
  Synthetic Polypeptide encoding a CAR with optional accessory module(s)
MALPVTALLLPLALLLHAARPDDIQLTQSPSSLSASVGDRVTITCKASQSVDYEGDSFLNWYQQKPGKAPKLLIYAASNLESGVPSRFSGSGSGTDFTLTISSLQPEDFATYYCQQSNEDPLTFGQGTKVEIKRGGGGSGGGGSGGGGSEVQLVESGGGLVQPGGSLRLSCAASGYTFSSYWIEWVRQAPGKGLEWIGEILPGGGDTNYNEIFKGRATFSADTSKNTAYLQMNSLRAEDTAVYYCTRRVPIRLDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5301 - protein, 723 aa, Artificial Sequence
  Synthetic Polypeptide encoding a CAR with optional accessory module(s)
MALPVTALLLPLALLLHAARPDIVMTQTPLSLSVTPGQPASISCKSSQSLLDGDGKTYLNWLLQKPGQSPQRLIYLVSKLDSGVPDRFSGSGSGTDFTLKISRVEAEDVGVYYCWQGTHFPRTFGQGTKLEIKGGGGSGGGGSGGGGSQVQLVQSGAEVKKPGASVKVSCKASGYTFKDTYIHWVRQAPGQGLEWMGRIDPANGNTKYDPKFQGRVTMTRDTSISTAYMELSRLRSDDTAVYYCARRGGVDWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5302 - protein, 731 aa, Artificial Sequence
  Synthetic Polypeptide encoding a CAR with optional accessory module(s)
MALPVTALLLPLALLLHAARPDIVMTQSPDSLAVSLGERATINCESSQSLLNSGNQKNYLTWYQQKPGQPPKPLIYWASTRESGVPDRFSGSGSGTDFTLTISSLQAEDVAVYYCQNDYSYPYTFGQGTKLEIKRGGGGSGGGGSGGGGSEVQLVQSGAEVKKPGESLKISCKGSGYSFTDYYMKWARQMPGKGLEWMGDIIPSNGATFYNQKFKGQVTISADKSISTTYLQWSSLKASDTAMYYCARSHLLRASWFAYWGQGTMVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5303 - protein, 726 aa, Artificial Sequence
  Synthetic Polypeptide encoding a CAR with optional accessory module(s)
MALPVTALLLPLALLLHAARPDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKGGGGSGGGGSGGGGSQIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5304 - protein, 730 aa, Artificial Sequence
  Synthetic Polypeptide encoding a CAR with optional accessory module(s)
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKGGGGSGGGGSGGGGSEVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5305 - protein, 730 aa, Artificial Sequence
  Synthetic Polypeptide encoding a CAR with optional accessory module(s)
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKGGGGSGGGGSGGGGSQVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5306 - protein, 724 aa, Artificial Sequence
  Synthetic Polypeptide encoding a CAR with optional accessory module(s)
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQDYGFPWTFGQGTKVEIKRGGGGSGGGGSGGGGSEVQLVQSGAEVKKPGESLKISCKGSGYSFTSYWISWVRQMPGKGLEWMGIIDPSDSDTRYSPSFQGQVTISADKSISTAYLQWSSLKASDTAMYYCARGDGSTDLDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5307 - protein, 726 aa, Artificial Sequence
  Synthetic Polypeptide encoding a CAR with optional accessory module(s)
MALPVTALLLPLALLLHAARPQFVLTQPPSVSTNPGSTVKLSCKRNTGNIGSNYVNWYQQKPGQSPTTMIYRDDKRPDGVPDRFSGSIDRSSNSALLTINNVQTEDEADYFCQSYSSGINIIFGGGTKLTVLGGGGSGGGGSGGGGSQVQLQESGPGLVKPSETLSLTCTVSGFSLTTYDVHWVRQPPGKGLEWMGRIQNAGITDYNSALKSRLIISRDTSKSQVFLKMNSVTTADTAMYFCAKTGSYFYAFDHWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5308 - protein, 723 aa, Artificial Sequence
  Synthetic Polypeptide encoding a CAR with optional accessory module(s)
MALPVTALLLPLALLLHAARPDIQMTQSPASLSASLGETVTIECRPSEDIHSNVAWYQQKPGNSPQLLIYDASNLADGVPSRFSGSGSGTQYSLKINSLQSEDVASYFCHQYNIYPYTFGSGTKLELKGGGGSGGGGSGGGGSQVQLQESGPTLVKPGDSVKMSCKASGYTFTDYIIHWVKQSHGKSLEWIGYINPYSDGTNYNEKFKSKATLTVDKSTSTAYMEFSRLTSEDSAIYFCALNYGSYYAMDAWGQGTSVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5309 - protein, 724 aa, Artificial Sequence
  Synthetic Polypeptide encoding a CAR with optional accessory module(s)
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGQGTKVEIKRGGGGSGGGGSGGGGSEVQLLESGGGLVQPGGSLRLSCAASGFTFSGYWMHWVRQAPGKGLEWVSAIRSDGSSKYYADSVKGRFTISRDNSKNTLYLQMNSLRAEDTAVYYCAKDGVIEDTFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5310 - protein, 720 aa, Artificial Sequence
  Synthetic Polypeptide encoding a CAR with optional accessory module(s)
MALPVTALLLPLALLLHAARPDVQITQSPSYLAASPGETITINCRASKSISKDLAWYQEKPGKTNKLLIYSGSTLQSGIPSRFSGSGSGTDFTLTISSLEPEDFAMYYCQQHNKYPYTFGGGTKLEIKRGGGGSGGGGSGGGGSQVQLQQPGAELVRPGASVKLSCKASGYTFTSYWMNWVKQRPDQGLEWIGRIDPYDSETHYNQKFKDKAILTVDKSSSTAYMQLSSLTSEDSAVYYCARGNWDDYWGQGTTLTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5311 - protein, 751 aa, Artificial Sequence
  Synthetic Polypeptide encoding a CAR with optional accessory module(s)
MALPVTALLLPLALLLHAARPYINIYNAEPANPSEKNSPTQYAYGSGEFDIQMTQSPASLSASLGETVTIECRTSKDIYSNLAWFQQEPGNSPQLLIYDASNLADGVPSRFSGSGSGTQYSLQINNLQSEDVASYFCHQYNNYPYTFGTGTKLELKGGGGSGGGGSGGGGSQVQLQESGPTLVNPGDSVKMSCKASGYTFTDHIIHWVKQSHGKSLEWIGYINPYSGGANYNGKFKSKATLTIDKSSSTAYMEFSRLTSGDSAIYYCALNYGSYYAMDAWGQGTSVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5312 - protein, 722 aa, Artificial Sequence
  Synthetic Polypeptide encoding a CAR with optional accessory module(s)
MALPVTALLLPLALLLHAARPEIVLTQSPTSMTASPGEQVTITCRASSSINYMHWYQQKPGASPRPWIYETSKLASGVPDRFSGSASGTSYSLTINNMEAEDAATYYCQQWNYPSWTFGGGTKLELKGGGGSGGGGSGGGGSEVQLVESGGGLVQPGRSLKLSCAASGFTFSDYNMAWVRQAPKKGLEWVATILYDGGRTYYRGSVKGRFTISRDNAKSTLYLRMDSLRSEDTATYYCATHSRGTDYFDYWGQGVMVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5313 - protein, 731 aa, Artificial Sequence
  Synthetic Polypeptide encoding a CAR with optional accessory module(s)
MALPVTALLLPLALLLHAARPDIVMTQSPSSLAVSEGETVTINCKSSQSFLSSGDGKNYVAWYQYKPGQSPKLLIYWASTRQSGVPDRFIGSGSGTDFTLTISTVQAEDLAIYYCQQYYDTPLTFGSGTKLEIKGGGGSGGGGSGGGGSEVKLQESGPSLVQSSQTLSLTCTVSGFSLTSYHIHWVRQTPGKGLEWMGVMWSDGDTSYNSALKSRLSISRDTSQSQVFLKMNSLQTEDTATYYCARGYYSSYLYLWFAYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5314 - protein, 735 aa, Artificial Sequence
  Synthetic Polypeptide encoding a CAR with optional accessory module(s)
MALPVTALLLPLALLLHAARPDVLMTQTPVSLPVSLGGQVSISCRSSQSLVHSDGDTYLHWYLQKPGQSPQLLIYRVSNRFSGVPDRFSGSGSGTDFTLKISRVEPEDLGLYYCLQTTHFPPWTFGGGTKLEMKGGGGSGGGGSGGGGSQVQLQQSGPELRRPGSSVRLSCKASGYRIKDFLIHWIKNRPEHGLEWIGWIDPEDGETKYAQKFQTKATLTADTSSNTAYMQLSSLTSEDTATYFCARWGDVYYGLMRGHVMDAWGQGTSVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5315 - protein, 726 aa, Artificial Sequence
  Synthetic Polypeptide encoding a CAR with optional accessory module(s)
MALPVTALLLPLALLLHAARPDIQMTQSTSSLSASLGDRVTISCSASQGINNYLNWYQQKPDGTVELLIYYTSTLQSGVPSRFSGSGSGTDYSLTISNLEPEDIGTYYCQQYSKLPRTFGGGTKLEIKGGGGSGGGGSGGGGSQVQLQQSGSELMMPGASVKISCKATGYTFSNYWIEWVKQRPGHGLEWIGEILPGTGRTIYNEKFKGKATFTADISSNTVQMQLSSLTSEDSAVYYCARRDYYGNFYYAMDYWGQGTSVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5316 - protein, 721 aa, Artificial Sequence
  Synthetic Polypeptide encoding a CAR with optional accessory module(s)
MALPVTALLLPLALLLHAARPDIQMTQSPASLSVSVGETVTITCRASENIYSNLAWYQQKQGKSPQLLVYAATNLADGVPSRFSGSGSGTQYSLKINSLQSEDFGSYYCQHFWGTWTFGGGTTLEIKGGGGSGGGGSGGGGSEVQLQQSGPELVKPGASVKMSCKASGYTFTDYYMKWMKQSHGKSLEWIGDINPNNGGTTYNQKFKGKATLTVDKSSSTAYMQLNSLTSEDSAVYYCARDYGYGYFDYWGQGTTLTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5317 - protein, 724 aa, Artificial Sequence
  Synthetic Polypeptide encoding a CAR with optional accessory module(s)
MALPVTALLLPLALLLHAARPEIVLTQSPGTLSLSPGERATLSCRASQSVGGYLAWYQQKPGQAPRLLIYDASNRATGIPARFSGSGSGTDFTLTISSLEPEDFAVYYCQQRNNWPPMYTFGQGTKLEIKRGGGGSGGGGSGGGGSQVQLVQSGAEVKKPGSSVKVSCKASGGTFSSYAISWVRQAPGQGLEWMGGIIPILGTANYAQKFQGRVTITADESTSTAYMELSSLRSEDTAVYYCARWGGGAFDIWGQGTMVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5318 - protein, 719 aa, Artificial Sequence
  Synthetic Polypeptide encoding a CAR with optional accessory module(s)
MALPVTALLLPLALLLHAARPQIVLTQSPALMSASPGEKVTMTCSASSSVRYMYWYQQKPRSSPKPWIHLTSNLASGVPARFSGSGSGTSYSLTISSMEAEDAATYYCQQWSSHPFTFGSGTKLEIKGGGGSGGGGSGGGGSDVQLQESGPGLVKPSQSLSLTCTVTGFSITSDYSWNWIRQFPGNKLEWMGYISYSGHTSYNPSLESRISITRDTSKNQFFLQLNSVTTEDTATYYCTRGNWDVVYWGQGTLVTVSATREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5319 - protein, 729 aa, Artificial Sequence
  Synthetic Polypeptide encoding a CAR with optional accessory module(s)
MALPVTALLLPLALLLHAARPDVVMTQSPLSLPVTLGQPASISCRSSQSIVHSDGNTYLEWYQQRPGQSPRRLIYKVSNRFSGVPDRFSGSGSGTDFTLKISRVEAEDVGVYYCFQGSHAPWTFGGGTKVEIKGGGGSGGGGSGGGGSEVQLVESGGGLVQPGGSLRLSCAASGFTFSSYGMHWVRQAPGKGLEWVAYITTRSSTIYYADSVKGRFTISRDNAKNSLYLQMNSLRAEDTAVYYCTREPLTGYYAMDYWGQGTSVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5320 - protein, 721 aa, Artificial Sequence
  Synthetic Polypeptide encoding a CAR with optional accessory module(s)
MALPVTALLLPLALLLHAARPDIQMTQSPSSLSASVGDRVTITCRASQSISLWLNWYQQKPGKAPKLLIYAASTLQSGVPSRFSGSGSGTDFTLTISSLQPEDFATYYCQQYYTSPYTFGQGTKVEIKRGGGGSGGGGSGGGGSQVQLLESGGGLVQPGGSLRLSCAASGFTFSSYAMSWVRQAPGKGLEWVSVIRSSGSSTYYADSVKGRFTISRDNSKNTLYLQMNSLRAEDTAVYYCARGGGYFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5321 - protein, 724 aa, Artificial Sequence
  Synthetic Polypeptide encoding a CAR with optional accessory module(s)
MALPVTALLLPLALLLHAARPDIQMTQSPSSLSASVGDRVTITCRASQSISSYLNWYQQKPGKAPKLLIYAVSTLQSGVPSRFSGSGSGTDFTLTISSLQPEDFATYYCQQSGTFPPTTFGQGTKVEIKRGGGGSGGGGSGGGGSQVQLLESGGGLVQPGGSLRLSCAASGFTFSSHGMHWVRQAPGKGLEWVSVISGSGSNTGYADSVKGRFTISRDNSKNTLYLQMNSLRAEDTAVYYCARQWGSYAFDSWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5322 - protein, 734 aa, Artificial Sequence
  Synthetic Polypeptide encoding a CAR with optional accessory module(s)
MALPVTALLLPLALLLHAARPDIVMSQSPSSLAVSVGEKVTMSCKSSQSLLHSSNQKNYLAWYQQKPGQSPKVLIYWASTRESGVPDRFTGSGSGTDFTLTITSVKSEDLAVYYCQQYYSYPWTFGGGTRLEIKRGGGGSGGGGSGGGGSEVQLQQSVAELVKPGASVKMSCKVSGYTLTDHTIHWMKQRPEQGLEWIGYIYPRDGITGYNEKFKGKATLTADTSSSTAYMQLNSLTSEDSAVYFCARWGYSYRNYAYYYDYWGQGTTLTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5323 - protein, 731 aa, Artificial Sequence
  Synthetic Polypeptide encoding a CAR with optional accessory module(s)
MALPVTALLLPLALLLHAARPEIVLTQSPGTLSLSPGERATLSCRASQSVSSSYLAWYQQKPGQAPRLLIYGTSSRATGIPDRFSGSGSGTDFTLTISRLEPEDFAVYYCQQYGSSPFTFGGGTKVEIKRGGGGSGGGGSGGGGSQVQLQESGPGLAKPSETLSLTCTVSGDSITSYYWSWIRQPPGKGLEWIGYIYYSGSTNYNPSLKSRVTISVDTSKNQFSLKLSSVTAADTAVYYCARDQRRIAAAGTHFYGMDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5324 - protein, 723 aa, Artificial Sequence
  Synthetic Polypeptide encoding a CAR with optional accessory module(s)
MALPVTALLLPLALLLHAARPDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKGGGGSGGGGSGGGGSQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSATREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5325 - protein, 716 aa, Artificial Sequence
  Synthetic Polypeptide encoding a CAR with optional accessory module(s)
MALPVTALLLPLALLLHAARPMTQSPKFLLVSAGDRVTLTCKASQSVNNDVYWYQQEPGQSPKLLIYWASTRESGVPDRFTGSGSGTDFTLTISSVQAEDLAVYYCKQSYNLYTFGGGTKLEIKRGGGGSGGGGSGGGGSESGRGLVQPGGSRKLSCAASGFTFSTSGMHWVRQAPEKGLEWVAYISSGSTTIYHADTVKGRFTISRDNPKNTLFLQMTSLRSEDTAMYYCCARSGQFGNYFDYWGQGTTLTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5326 - protein, 721 aa, Artificial Sequence
  Synthetic Polypeptide encoding a CAR with optional accessory module(s)
MALPVTALLLPLALLLHAARPQSPSSLAVSAGEKVTMSCKSSQSLLNSRTRKNYLAWYQQKPGQSPKLLIYWASTRESGVPDRFTGSGSGTDFTLTISSVQAEDLAVYYCKQSNLYTFGGGTKLEIKGGGGSGGGGSGGGGSQVQLEESGPELVKPGASVKLSCKASGYTFTEYIIHWVKQRSGQGLEWIGWFYPGSGSIKYNEKFKDKATLTADKSSSTVYMELSGLTSEDSAVYFCARHDGYSYFDYWGQGTTLTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5327 - protein, 733 aa, Artificial Sequence
  Synthetic Polypeptide encoding a CAR with optional accessory module(s)
MEMFQGLLLLLLLSMGGTWASREMLRPRCRPINATLAVEKEGCPVCITVNTTICAGYCPTMTRVLQGVLPALPQVVCNYRDVRFESIRLPGCPRGVNPVVSYAVALSCQCALCRRSTTDCGGPKDHPLTCDDPRFQASSSSKAPPPSLPSPSRLPGPSDTPILPQGGGGSGGGGSGGGGSAPDVQDCPECTLQENPFFSQPGAPILQCMGCCFSRAYPTPLRSKKTMLVQKNVTSESTCCVAKSYNRVTVMGGFKVENHTACHCSTCYYHKSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5328 - protein, 724 aa, Artificial Sequence
  Synthetic Polypeptide encoding a CAR with optional accessory module(s)
MALPVTALLLPLALLLHAARPDIQMTQSPSSLSASLGERVSLTCRATQELSGYLSWLQQKPDGTIKRLIYAASTLDSGVPKRFSGNRSGSDYSLTISSLESEDFADYYCLQYAIYPYTFGGGTKLEIKGGGGSGGGGSGGGGSEVQLQQSGPELVKPGASVKMSCKASGYTFTSYFIHWVKQKPGQGLEWIGFINPYNDGSKYNEKFKGKATLTSDKSSSTAYMELSSLTSEDSAVYYCTRDDGYYGYAMDYWGQGTSVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5329 - protein, 729 aa, Artificial Sequence
  Synthetic Polypeptide encoding a CAR with optional accessory module(s)
MALPVTALLLPLALLLHAARPDTIVLTQSPASLAVSLGQRATISCRASESVDSYGNSFMHWYQQKPGQPPKLLIYLASNLESGVPARFSGSGSRTDFTLTIDPVEADDAATYYCQQNNYDPWTFGGGTKLEIKGGGGSGGGGSGGGGSEVQLQQSGPELVKPGASVKMSCKASGYTFTSYVMHWVKQKPGQGLEWIGYINPYNDGTKYNEKFKGKATLTSDTSSSTAYMELNSLTSEDSAVYFCARPIYFDNDYFDYWGQGTTLKVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5330 - protein, 724 aa, Artificial Sequence
  Synthetic Polypeptide encoding a CAR with optional accessory module(s)
MALPVTALLLPLALLLHAARPDIQMTQSPSSLSASVGDRVTITCKASQDVSTAVAWFQQKPGKAPKLLIYSPSYRYTGVPSRFSGSGSGTDFTLTISSLQPEDFTYYCQQLYSTPYTFGQGTKVEIKGGGGSGGGGSGGGGSEVQLVQSGAEVKKPGASVKVSCKASGYTFTDYYLDVVVRQAPGQGLEWIGRVNPYNGGTIYNQKFKGRVTLTRDTSTSTAYLELSSLRSEDTAVYYCARDHYRYDPLLDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5331 - protein, 730 aa, Artificial Sequence
  Synthetic Polypeptide encoding a CAR with optional accessory module(s)
MALPVTALLLPLALLLHAARPDIQMTQSPSSLSASVGDRVTITCRASQSVSTSSYNYMHWYQQKPGKPPKLLIKYASNLESGVPSRFSGSGSGTDFTLTISSLQPEDFATYYCQHSWEIPLTFGQGTKVEIKGGGGSGGGGSGGGGSEVQLVQSGAEVKKPGASVKVSCKASGYSFTDYYMHWVRQAPGQGLEWIGRINPYNGAAFYSQNFKDRVTLTVDTSTSTAYLELSSLRSEDTAVYYCAIERGADLEGYAMDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5332 - protein, 728 aa, Artificial Sequence
  Synthetic Polypeptide encoding a CAR with optional accessory module(s)
MALPVTALLLPLALLLHAARPEIVLTQSPATLSASPGERVTLTCRASSNVISSYVHWYQQKPGSSPRLFLYSTSNLASGVPSRFSGSGSGTDFTFTISSLEAEDAATYYCQQYSGYPLTFGQGTRLEIKGGGGSGGGGSGGGGSQVQLQESGPGLVKPSETLSLTCAVSGYSITSAYYWNWIRQPPGKGLEWIGYISYDGRNNYNPSLKNRITINPDTSKNQFSLQLNSVTPEDTAVYYCAREGDYDVGNYYAMDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5333 - protein, 728 aa, Artificial Sequence
  Synthetic Polypeptide encoding a CAR with optional accessory module(s)
MALPVTALLLPLALLLHAARPEIVLTQSPATLSLSPGERATLSCRASSNVISSYVHWYQQKPGQAPRLLIYSTSNLASGIPARFSGSGSGTDFTLTISSLEPEDFAVYYCQQYSGYPLTFGQGTRLEIKGGGGSGGGGSGGGGSEVQLVESGGGLVQPGRSLRLSCAASGYSITSAYYWNWVRQAPGKGLEWVSYISYDGRNNYNPSLKNRFTISRDNAKKSLYLQMNSLRAEDTALYYCAKEGDYDVGNYYAMDYWGQGTTVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5334 - protein, 740 aa, Artificial Sequence
  Synthetic Polypeptide encoding a CAR with optional accessory module(s)
MALPVTALLLPLALLLHAARPDLNFMLTQPHSVSGSPGKTVTISCTRSTGSITSNYVHWYQQRPGSSPTTVICEDNERPSGVPDRFSGSIDISSNSASLTISGLKTEDEADYYCQSYDDSNHISVFGTGTKVTVLGQPKANPGGGGSGGGGSGGGGSQVQLQESGPGLVKPSETLSLTCTVSGGSISSSNYYWGWIRQPPGKGLEWIGAIYYSGSTYYNPSLKSRVAISVDTSKNQFSLKLSSVTAADTAVYYCARRIGVAGQWYFDLWGRGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5335 - protein, 726 aa, Artificial Sequence
  Synthetic Polypeptide encoding a CAR with optional accessory module(s)
MALPVTALLLPLALLLHAARPDIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIKGGGGSGGGGSGGGGSQIQLVQSGPDLKKPGETVKISCKASGYTFTNTGMNWVKQAPGKGLKWMGWINTYTGEPTYADDFKGRFTFSLETSASTAYLQINNLKNEDTATYFCTRWGYGSSLYYAMDYWGQGTSVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5336 - protein, 723 aa, Artificial Sequence
  Synthetic Polypeptide encoding a CAR with optional accessory module(s)
MALPVTALLLPLALLLHAARPDIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIKGGGGSGGGGSGGGGSEVQLVESGGGLVQPGGSLRLSCAASGFDFSRYWMSWVRQAPGKGLEWIGEINPDSSTINYAPSLKDKFIISRDNAKNSLYLQMNSLRAEDTAVYYCARPDGNYWYFDVWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5337 - protein, 724 aa, Artificial Sequence
  Synthetic Polypeptide encoding a CAR with optional accessory module(s)
MALPVTALLLPLALLLHAARPDIVMTQSQKSMSTSVGDRVSITCKASQDVITGVAWYQQKPGQSPKLLIYSASYRYTGVPDRFTGSGSGTDFTFTISNVQAEDLAVYYCQQHYSTPLTFGAGTKLELKGGGGSGGGGSGGGGSQVQLQQPGAELVRPGASVKLSCKASGYSFTTYWMNWVKQRPGQGLEWIGMIHPSDSETRLNQKFKDKATLTVDKSSSTAYMQLSSPTSEDSAVYYCARSTMIATRAMDYWGQGTSVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5338 - protein, 726 aa, Artificial Sequence
  Synthetic Polypeptide encoding a CAR with optional accessory module(s)
MALPVTALLLPLALLLHAARPDIQMTQSPSSLSASVGDRVTITCKASQDVSTAVAWYQQKPGKAPKLLIYSASYRYTGVPDRFTGSGSGTDFTLTISSLQPEDFATYYCQQHYSTPPYTFGGGTKVEIKRGGGGSGGGGSGGGGSQVQLVQSGAEVKKPGASVKVSCKASGYAFSSSWMNWVRQAPGQGLEWIGRIYPGDGDTKYNGKFKGKATLTADKSTSTAYMELSSLRSEDTAVYYCARSTMIATGAMDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5339 - protein, 727 aa, Artificial Sequence
  Synthetic Polypeptide encoding a CAR with optional accessory module(s)
MALPVTALLLPLALLLHAARPDVVMTQTPLSLSVTPGQPASISCRSSQSLVHNNGNTYLHWYLQKPGQSPQLLIYKVSNRFSGVPDRFSGSGSGTDFTLKISRVEAEDVGVYFCSQSTHVPPYTFGGGTKVEIKGGGGSGGGGSGGGGSEVQLVESGGGLVQPGGSLRLSCAASGFTFSDYYMAWVRQAPGKGLEWVAEINYDGSSTYYVDSVKGRFTISRDNAKNSLYLQMNSLRAEDTAVYYCARDRGFYFDYWGQGTTVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5340 - protein, 727 aa, Artificial Sequence
  Synthetic Polypeptide encoding a CAR with optional accessory module(s)
MALPVTALLLPLALLLHAARPDVVMTQTPLSLSVTPGQPASISCRSSQSLVHSNGLTYLHWYLQKPGQSPQLLIYKVSNRFSGVPDRFSGSGSGTDFTLKISRVEAEDVGVYFCSQSTHVPPFTFGGGTKVEIKGGGGSGGGGSGGGGSEVQLVESGGGLVQPGGSLRLSCAASGFTFSDYYMAWVRQAPGKGLEWVASINYDGESTYYVDSVKGRFTISRDNAKNSLYLQMNSLRAEDTAVYYCARDRGYYFDYWGQGTTVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5341 - protein, 727 aa, Artificial Sequence
  Synthetic Polypeptide encoding a CAR with optional accessory module(s)
MALPVTALLLPLALLLHAARPDVVMTQSPLSLPVTPGEPASISCRSSQSLVHSNGNTYLHWYLQKPGQSPQLLIYKVSNRFSGVPDRFSGSGSGTDFTLKISRVEAEDVGVYFCSQSTHVPPFTFGGGTKVEIKGGGGSGGGGSGGGGSEVQLVESGGGLVQPGGSLRLSCAASGFTFSDYYMAWVRQAPGKGLEWVADINYDGGSTYYLDSLKSRFTISRDNAKNSLYLQMNSLRAEDTAVYYCARDRGYYFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5342 - protein, 725 aa, Artificial Sequence
  Synthetic Polypeptide encoding a CAR with optional accessory module(s)
MALPVTALLLPLALLLHAARPDIQMTQSSSYLSVSLGGRVTITCKASDHINNWLAWYQQKPGNAPRLLISGATSLETGVPSRFSGSGSGKDYTLSITSLQTEDVATYYCQQYWSTPWTFGGGTKLEIKGGGGSGGGGSGGGGSQVQLQQSGAELARPGASVKLSCKASGYTFTSYWMQWVKQRPGQGLEWIGAIYPGDGDTRYTQKFKGKATLTADKSSSTAYMQLSSLASEDSAVYYCARGKVYYGSNPFAYWGQGTLVTVSATREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5343 - protein, 725 aa, Artificial Sequence
  Synthetic Polypeptide encoding a CAR with optional accessory module(s)
MALPVTALLLPLALLLHAARPDIVMTQSHKFMSTSVGDRVSITCKASQDVSTAVAWYQQKPGQSPKLLIYSASYRYTGVPDRFTGSGSGTDFTFTISSVQAEDLAVYYCQQHYSTPPYTFGGGTKLEIKGGGGSGGGGSGGGGSQVQLQQSGPELVKPGASVKISCKASGYAFSSSWMNWVKQRPGQGLEWIGRIYPGDGDTKYNGKFKGKATLTADKSSSTAYMQLSSLTSVDSAVYFCARSTMIATGAMDYWGQGTSVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5344 - protein, 730 aa, Artificial Sequence
  Synthetic Polypeptide encoding a CAR with optional accessory module(s)
MALPVTALLLPLALLLHAARPQSVLTQPPSVSGAPGQRVTISCTGSGSNIGAPYDVSWYQQLPGTAPKLLIYHNNKRPSGVPDRFSGSKSGTSASLAITGLQAEDEADYYCATVEAGLSGSVFGGGTKLTVLGAGGGGSGGGGSGGGGSQVQLVQSGAEVKKPGASVKVSCKVSGYTLTELSIHWVRQAPGKGLEWMGGFDPEENEIVYAQRFQGRVTMTEDTSTDTAYMELSSLRSEDTAVYYCAIVGSFSPLTLGLWGQGTMVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5345 - protein, 730 aa, Artificial Sequence
  Synthetic Polypeptide encoding a CAR with optional accessory module(s)
MALPVTALLLPLALLLHAARPQSVLTQPPSVSGAPGQRVTISCTGSGSNIGAPYDVSWYQQLPGTAPKLLIYHNNKRPSGVPDRFSGSKSGTSASLAITGLQAEDEADYYCQSYDSSSISTIFGGGTKLTVLGAGGGGSGGGGSGGGGSQVQLVQSGAEVKKPGASVKVSCKVSGYTLTELSIHWVRQAPGKGLEWMGGFDPEENEIVYAQRFQGRVTMTEDTSTDTAYMELSSLRSEDTAVYYCAIVGSFSGIAYRPWGQGTMVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5346 - protein, 741 aa, Artificial Sequence
  Synthetic Polypeptide encoding a CAR with optional accessory module(s)
MALPVTALLLPLALLLHAARPDEFEVQLVESGGGLVQAGGSLRLSCVASGISSSKRNMGWYRQAPGKQRESVATISSGGNKDYTDAVKDRFTISRDTTKNTVYLQMNSLKPEDTAVYYCKIEAGTGWATRRGYTYWGQGTLVTVSSLEGGGGSGGGGSGGGGSFEVQLVESGGGLVQAGGSLRLSCAASGSIFSGNVMGWYRRQAPGKEREWVAAIASGGSIYYRDSVKGRFTISRDNAKNTVYLQMNSLKPEDTAVYYCNSHPPTLPYWGLGTQVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5347 - protein, 775 aa, Artificial Sequence
  Synthetic Polypeptide encoding a CAR with optional accessory module(s)
MALPVTALLLPLALLLHAARPDEFEVQLVESGGGLVQAGDSLRLSCAASGRAFSRYAMGWFRQAPGKEREFVAAIGWGPSKTNYADSVKGRFTISRDNAKNTVYLQMNTLKPEDTAVYSCAAKFVNTDSTWSRSEMYTYWGQGTLVTVSSLEGGGGSGGGGSGGGGSGSGGSGSGGSGSGGSGSGGSFEVQLVESGGGSVQAGGSLRLSCTTSGRALNMYVMGWFRQAPGNEREFVAATSSSGGSTSYPDSVKGRFTISRDNAKNTVYLQMNSLKPEDTAAYRCAASPYVSTPTMNILEEYRYWGLGTQVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5348 - protein, 728 aa, Artificial Sequence
  Synthetic Polypeptide encoding a CAR with optional accessory module(s)
MALPVTALLLPLALLLHAARPDIQMTQSPSSLSASVGDRVTITCSASSSVSYMYWYQQKPGKAPKLLIYLTSNLASGVPSRFSGSGSGTDFTLTISSLQPEDFATYYCQQWRSNPFTFGQGTKLEIKRGGGGSGGGGSGGGGSQITLKESGPTLVKPTQTLTLTCTFSGFSLSTSGMGVGWIRQPPGKALEWLAHIWWDDVKRYSPSLKSRLTITKDTSKNQVVLTMTNMDPVDTATYYCARIVSFDNDVVSAMDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5349 - protein, 723 aa, Artificial Sequence
  Synthetic Polypeptide encoding a CAR with optional accessory module(s)
MALPVTALLLPLALLLHAARPEIVMTQSPATLSVSPGERATLSCKASQSVSNDVVWYQQKPGQAPRLLIYYASNRYTGIPARFSGSGSGTEFTLTISSLQSEDFAVYYCQQDYTSPWTFGQGTKLEIKRGGGGSGGGGSGGGGSQVQLVQSGAEVKKPGASVKVSCKASGYTFTNYGMNWVRQAPGQGLEWMGWINTYTGEPTYADDFKGRVTMTTDTSTSTAYMELRSLRSDDTAVYYCARIGDSSPSDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5350 - protein, 724 aa, Artificial Sequence
  Synthetic Polypeptide encoding a CAR with optional accessory module(s)
MALPVTALLLPLALLLHAARPDSTDIQMTQSPSSLSASVGDRVTITCRASQSISSYLNWYQQKPGKAPKLLIYLASNLQSGVPSRFSGSGSGTDFTLTISSLQPEDFATYYCQQAEYMPLTFGQGTKVEIKRAGGGGSGGGGSGGGGSEVQLLESGGGLVQPGGSLRLSCAASGFTFSGYAMSWVRQAPGKGLEWVSEIAPPGLNTRYADSVKGRFTISRDNSKNTLYLQMNSLRAEDTAVYYCAKSDTAFDYWGQGTLVTVSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5351 - protein, 727 aa, Artificial Sequence
  Synthetic Polypeptide encoding a CAR with optional accessory module(s)
MALPVTALLLPLALLLHAARPDQAVLTQESALTTSPGETVTLTCRSSTGAVTTSNYANWVQEKPDHLFTGLIGGTNNRVPGVPARFSGSLIGDKAALTITGAQTEDEAIYFCVLWHSNHWVFGGGTKLTVLGGGGSGGGGSGGGGSDVQLVESGGGLVQPGGSRKLSCAASGFTFSSFGMHWVRQAPEKGLEWVAYISSGSSTLHYADTVKGRFTISRDNPKNTLFLQMTSLRSEDTAMYYCARWGNYPHYAMDYWGQGTSVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5352 - protein, 609 aa, Artificial Sequence
  Synthetic Polypeptide encoding a CAR with optional accessory module(s)
MALPVTALLLPLALLLHAARPDEFEVQLVESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5353 - protein, 751 aa, Artificial Sequence
  Synthetic Polypeptide encoding a CAR with optional accessory module(s)
MALPVTALLLPLALLLHAARPDEFEVQLVESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTLVTVSSLEGGGGSGGGGSGGGGSFEEVQLVESGGGSVQAGGSLRLSCAASGDTYGSYWMGWFRQAPGKEREGVAAINRGGGYTVYADSVKGRFTISRDTAKNTVYLQMNSLRPDDTADYYCAASGVLGGLHEDWFNYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5354 - protein, 770 aa, Artificial Sequence
  Synthetic Polypeptide encoding a CAR with optional accessory module(s)
MALPVTALLLPLALLLHAARPDEFEVQLVESGGGSVQAGGSLRLTCAASGSTSRSYGMGWFRQAPGKEREFVSGISWRGDSTGYADSVKGRFTISRDNAKNTVDLQMNSLKPEDTAIYYCAAAAGSTWYGTLYEYDYWGQGTLVTVSSLEGGGGSGGGGSGGGGSGSGGSGSGGSGSGGSGSGGSFEVQLVESGGGSVQAGGSLRLSCAASGDTYGSYWMGWFRQAPGQEREAVAAINRGGGYTVYADSVKGRFTISRDNAKNTLYLQMNSLRPDDTADYYCAASGVLGGLHEDWFNYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5355 - protein, 718 aa, Artificial Sequence
  Synthetic Polypeptide encoding a CAR with optional accessory module(s)
MALPVTALLLPLALLLHAARPDIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVEGGGGSGGGGSGGGGSEVQVLESGGGLVQPGGSLRLSCAASGFTFSSYAMSWVRQAPGKGLEWVSAISGSGGSTNYADSVKGRFTISRDNSKNTLYLQMNSLRAEDTAVYYCAGSSGWSEYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5356 - protein, 724 aa, Artificial Sequence
  Synthetic Polypeptide encoding a CAR with optional accessory module(s)
MALPVTALLLPLALLLHAARPDEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSGGGGSGGGGSGGGGSDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5357 - protein, 731 aa, Artificial Sequence
  Synthetic Polypeptide encoding a CAR with optional accessory module(s)
MALPVTALLLPLALLLHAARPDELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGGGGSGGGGSGGGGSEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5358 - protein, 732 aa, Artificial Sequence
  Synthetic Polypeptide encoding a CAR with optional accessory module(s)
MALPVTALLLPLALLLHAARPDELQMTQSPSSLSASVGDRVTITCRASQSISSYLNWYQQKPGQPPKLLIYWASTRESGVPDRFSGSESGTNYTLTISSLQPEDFATYFCQQSDSLPITFGQGTRLDIQGGGGSGGGGSGGGGSEVQLLESGGGVVQPGRSLRLSCAASGFTFSSYGMHWVRQAPGKGLEWVAVISYDGSNKYYADSVKGRFTISRDNSKNTLYLQMNSLRAEDTAVYYCAKDMGWGSGWRPYYYYGMDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5359 - protein, 729 aa, Artificial Sequence
  Synthetic Polypeptide encoding a CAR with optional accessory module(s)
MALPVTALLLPLALLLHAARPDDIQMTQSPSSLSASVGDRVTITCRASQSISSYLNWYQQKPGKAPKLLIYAASSLQSGVPSRFSGSGSGTDFTLTISSLQPEDLATYYCQQSYSTPFTFGPGTKVDIKGGGGSGGGGSGGGGSVHEVQLVQSGAEVKKPGSSVKVSCKASGGTFSSYAISWVRQAPGQGLEWMGGIIPIFGTANYAQKFQGRVTITADKSTSTAYMELSSLRSEDTAVYYCATFALFGFREQAFDIWGQGTTVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5360 - protein, 726 aa, Artificial Sequence
  Synthetic Polypeptide encoding a CAR with optional accessory module(s)
MALPVTALLLPLALLLHAARPDVVMTQTPLSLPVSLGDQASISCRSSQSLVHSNGNTYLRWYLQKPGQSPKVLIYKVSNRFSGVPDRFSGSGSGTDFTLKISRVEAEDLGVYFCSQSTHVPWTFGGGTKLEIKGGGGSGGGGSGGGGSEVKLDETGGGLVQPGRPMKLSCVASGFTFSDYWMNWVRQSPEKGLEWVAQIRNKPYNYETYYSDSVKGRFTISRDDSKSSVYLQMNNLRVEDMGIYYCTGSYYGMDYWGQGTSVTVSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5361 - protein, 737 aa, Artificial Sequence
  Synthetic Polypeptide encoding a CAR with optional accessory module(s)
MALPVTALLLPLALLLHAARPDVVMTQTPLSLPVSLGDQASISCRSSQSLVHSNGNTYLRWYLQKPGQSPKVLIYKVSNRVSGVPDRFSGSGSGTDFTLKINRVEAEDLGVYFCSQSTHVPWTFGGGTKLEIKSSADDAKKDAAKKDDAKKDDAKKDGGVKLDETGGGLVQPGGAMKLSCVTSGFTFGHYWMNWVRQSPEKGLEWVAQFRNKPYNYETYYSDSVKGRFTISRDDSKSSVYLQMNNLRVEDTGIYYCTGASYGMEYLGQGTSVTVSTTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5362 - protein, 733 aa, Artificial Sequence
  Synthetic Polypeptide encoding a CAR with optional accessory module(s)
MALPVTALLLPLALLLHAARPQVQLVESGGNLVQPGGSLRLSCAASGFTFGSFSMSWVRQAPGGGLEWVAGLSARSSLTHYADSVKGRFTISRDNAKNSVYLQMNSLRVEDTAVYYCARRSYDSSGYWGHFYSYMDVWGQGTLVTVSGGGGSGGGGSGGGGSSVLTQPSSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLGTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5363 - protein, 728 aa, Artificial Sequence
  Synthetic Polypeptide encoding a CAR with optional accessory module(s)
MALPVTALLLPLALLLHAARPDIQMTQSPSSLSASVGDRVTITCRTSQSLSSYTHWYQQKPGKAPKLLIYAASSRGSGVPSRFSGSGSGTDFTLTISSLQPEDFATYYCQQSRTFGQGTKVEIKGGGGSGGGGSGGGGSQVQLQQSGPGLVKPSQTLSLTCAISGDSVSSYNAVWNWIRQSPSRGLEWLGRTYYRSGWYNDYAESVKSRITINPDTSKNQFSLQLNSVTPEDTAVYYCARSGHITVFGVNVDAFDMWGQGTMVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5364 - protein, 727 aa, Artificial Sequence
  Synthetic Polypeptide encoding a CAR with optional accessory module(s)
MALPVTALLLPLALLLHAARPDIVLTQSPLSLAVSLGQPAIISCKASQSVSFAGTSLMHWYHQKPGQQPRLLIYRASNLEAGVPDRFSGSGSKTDFTLTISPVEAEDAATYYCQQSREYPYTFGGGTKLEIKRGGGGSGGGGSGGGGSQVQLVQSGAEVVKPGASVKISCKASGYTFTGYFMNWVKQSPGQSLEWIGRIHPYDGDTFYNQKFQGKATLTVDKSSNTAHMELLSLTSEDFAVYYCTRYDGSRAMDYWGQGTTVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5365 - protein, 700 aa, Artificial Sequence
  Synthetic Polypeptide encoding a CAR with optional accessory module(s)
MALPVTALLLPLALLLHAARPNSCELTNITIAIEKEECRFCISINTTWCAGYCYTRDLVYKDPARPKIQKTCTFKELVYETVRVPGCAHHADSLYTYPVATQCHCGKCDSDSTDCTVRGLGPSYCSFGEMKEGGGGSGGGGSGGGGSAPDVQDCPECTLQENPFFSQPGAPILQCMGCCFSRAYPTPLRSKKTMLVQKNVTSESTCCVAKSYNRVTVMGGFKVENHTACHCSTCYYHKSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5366 - protein, 731 aa, Artificial Sequence
  Synthetic Polypeptide encoding a CAR with optional accessory module(s)
MALPVTALLLPLALLLHAARPDLETTLTQSPATLSVSPGERVTLSCRASQSVGSNLAWYQQKFGQAPRLLIYDASTRATGIPARFSGSGSGTEFTLTISRLEPEDFAVYYCHQYGSSPRTFGQGTKVDIKRGGGGSGGGGSGGGGSQVQLVQSGAEVKKPGASVKVSCKASGYTFTTYGISWVRQAPGQGLEWMGWISAYNGHTNYAQMLQGRVTMTTDTSTSTAYMELRGLRSDDTAVYYCAREAYASYGSGSYWTDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5367 - protein, 724 aa, Artificial Sequence
  Synthetic Polypeptide encoding a CAR with optional accessory module(s)
MALPVTALLLPLALLLHAARPDDVVMTQTPLSLPVTPGEPASISCRSSQSLVHRNGNTYLHWYLQKPGQSPKLLIHKVSNRFSGVPDRFSGSGSGTDFTLKISRVEAEDLGVYFCSQSTHVPPLTFGAGTKLELKGGGGSGGGGSGGGGSEVQLVQSGAEVEKPGASVKISCKASGSSFTGYNMNWVRQNIGKSLEWIGAIDPYYGGTSYNQKFKGRATLTVDKSTSTAYMHLKSLRSEDTAVYYCVSGMEYWGQGTSVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5368 - protein, 722 aa, Artificial Sequence
  Synthetic Polypeptide encoding a CAR with optional accessory module(s)
MALPVTALLLPLALLLHAARPDEIVMTQTPATLSVSAGERVTITCKASQSVSNDVTWYQQKPGQAPRLLIYSASNRYSGVPARFSGSGYGTEFTFTISSVQSEDFAVYFCQQDYSSFGQGTKLEIKRGGGGSGGGGSGGGGSQVQLVESGPGVVQPGRSLRISCAVSGFSVTNYGVHWVRQPPGKGLEWLGVIWAGGITNYNSAFMSRLTISKDNSKNTVYLQMNSLRAEDTAMYYCASRGGHYGYALDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5369 - protein, 724 aa, Artificial Sequence
  Synthetic Polypeptide encoding a CAR with optional accessory module(s)
MALPVTALLLPLALLLHAARPDIQMTQTASSLPASLGDRVTISCSASQDISNYLNWYQQKPDGTVKLLIFYSSNLHSGVPSRFSGGGSGTDYSLTISNLEPEDIATYFCHQYSKLPWTFGGGTKLEIKRGGGGSGGGGSGGGGSEVTLVESGGDFVKPGGSLKVSCAASGFAFSHYAMSWVRQTPAKRLEWVAYISSGGSGTYYSDSVKGRFTISRDNAKNTLYLQMRSLRSEDSAMYFCTRVKLGTYYFDSWGQGTTLTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5370 - protein, 726 aa, Artificial Sequence
  Synthetic Polypeptide encoding a CAR with optional accessory module(s)
MALPVTALLLPLALLLHAARPQFVLTQSPSASAALGASAKLTCTLSSAHKTYTIDWYQQQKGKAPRYLIQVKSDGTYTKATGVPDRFSGSSSGADRYLIIPSVQADDEADYYCGTDYTGGYVFGGGTQLTVTGGGGSGGGGSGGGGSEQLKESGGGLFKPTDTLTLTCTVSGFSLSYYGVNWVRQAPGNGLEWIGTIGGSGDTYYASWAKSRSTIIRNTNENTVTLKMTSLTAADTATYFCVRYANIGYEYFNVWGPGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5371 - protein, 731 aa, Artificial Sequence
  Synthetic Polypeptide encoding a CAR with optional accessory module(s)
MALPVTALLLPLALLLHAARPQFVLTQSPSVSAALGASAKLTCTLSSAHKTYTIDWYQQQQGEAPRYLMQVKSDGSYTKGTGVPDRFSGSSSGADRYLIIPSVQADDEAGYVCGADDNGGYVFGGGTQLTVTGGGGSGGGGSGGGGSQSVKESEGGLFKPTDTLTLTCTVSGFSLSRHALTWVRQAPGNGLEWIGAIDNAGTTYYASWAKSRSTITRNTDLHTVTLKMTSLTASDTATYFCARVFYDINSGYYLDGMDLWGPGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5372 - protein, 725 aa, Artificial Sequence
  Synthetic Polypeptide encoding a CAR with optional accessory module(s)
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKGGGGSGGGGSGGGGSEVQLVESGGGLVQPGESLRLSCVASGFTFSRYKMNWVRQAPGKGLEWVSYISRSGRDIYYADSVKGRFTISRDNAKNSLYLQMNSLRDEDTAVYYCAGTVTTYYYFGMDVWGHGTTVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5373 - protein, 726 aa, Artificial Sequence
  Synthetic Polypeptide encoding a CAR with optional accessory module(s)
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKGGGGSGGGGSGGGGSEVQLVESGGGSVQPGESLRLSCVASGFTFSRYKMNWVRQAPGKGLEWVSYISRSGRDIYYADSVKGRFTISRDNAKNSLYLQMNSLRDEDTAVYYCAGTVTTYYYDFGMDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5374 - protein, 725 aa, Artificial Sequence
  Synthetic Polypeptide encoding a CAR with optional accessory module(s)
MALPVTALLLPLALLLHAARPQSVLTQPPSASGTPGQRVTISCSGSRSNVGGNYVFWYQQVPGATPKLLIYRSNQRPSGVPDRFAGSKSGSSASLAISGLRSEDEADYYCATWDDSLSGFVFGTGTKVTVLGGGGGSGGGGSGGGGSEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARGYGKAYDQWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5375 - protein, 724 aa, Artificial Sequence
  Synthetic Polypeptide encoding a CAR with optional accessory module(s)
MALPVTALLLPLALLLHAARPQSVVTQPPSMSAAPGQQVTISCSGGNSNIERNYVSWYLQLPGTAPKLVIFDNDRRPSGIPDRFSGSKSGTSATLGITGLQTGDEADYYCGTWDSSLRGWVFGGGTKLTVLGGGGGSGGGGSGGGGSEVQLVESGGGLIQPGGSLRLSCAASGFTFSNYAMNWVRQAPGKGLEWVSTINGRGSSTIYADSVKGRFTISRDNSKNTLYLQMNSLRAEDTATYYCARYISRGLGDSWGQGTLVTVTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5376 - protein, 724 aa, Artificial Sequence
  Synthetic Polypeptide encoding a CAR with optional accessory module(s)
MALPVTALLLPLALLLHAARPQSVVTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSYVFGTGTKLTVLGGGGGSGGGGSGGGGSEVQLVETGGNLVQPGASLRLSCAASGFSFSGTAMHWVRQAPGKGLEWVSTISSTGRSTYYRDSVKGRFTISRDNSKNTLYLQMNSLRGEDTAVYYCARVSFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5377 - protein, 726 aa, Artificial Sequence
  Synthetic Polypeptide encoding a CAR with optional accessory module(s)
MALPVTALLLPLALLLHAARPQSVVTQPASVSGSPGQSITISCTGTSSDVGGYNYVSWYQQHPGKAPKLMIYDVSKRPSGVSNRFSGSKSGNTASLTISGLQAEDEADYYCSSYTSSSTLVFGGGTKLTVLGGGGGSGGGGSGGGGSEVQLVESGGAFVQPGGSLRLSCAASGFTFSSYAMTWVRQAPGKGLEWVSTISGRGRSTFYADSVKGRFTISRDNSKNTLYLQMNSLRAEDTAVYYCARYYHAGAFDLWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5378 - protein, 724 aa, Artificial Sequence
  Synthetic Polypeptide encoding a CAR with optional accessory module(s)
MALPVTALLLPLALLLHAARPDNIELTQSPAIMSASPGERVTMTCSASSSIRYIYWYQQKPGSSPRLLIYDTSNVAPGVPFRFSGSGSGTSYSLTINRMEAEDAATYYCQEWSGYPYTFGGGTKLDIKRGGGGSGGGGSGGGGSQVKLQESGGGLVKPGGSLKLSCAASGFTFSSYGMSWVRQTPDKRLEWVATISSGGSYTYYPDSVKGRFTISRDNAKNTLYLQMSSLKSEDTAMYYCARGNWEGWYFDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5379 - protein, 734 aa, Artificial Sequence
  Synthetic Polypeptide encoding a CAR with optional accessory module(s)
MALPVTALLLPLALLLHAARPDNFMLTQPHSVSESPGKTVTISCTGSGGSIDNNYVHWYQQRPGSAPTTVMFEDNQRPSGVPDRFSGSIDSSSNSASLVISGLKTEDEGDYYCQSSDGSKVVFGGGTKLTVLGQGGGGSGGGGSGGGGSEVQLVQSGGGSLTLSCAASGVVQPGRFTFSSYGMHWVRQAPGKGLEWVSVISYDGSNKYYADSVKGRFTISRDNSKNTLYLQMNSLRTEDTAVYYCAKTLSAGEWIGGGAFDIWGHGTMVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5380 - protein, 724 aa, Artificial Sequence
  Synthetic Polypeptide encoding a CAR with optional accessory module(s)
MALPVTALLLPLALLLHAARPDVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQNTPVPPKFGSGTKLEIKGGGGSGGGGSGGGGSQVQLQQSGAELVRPGASVKLSCKASGYTFNDYEMHWVKQTPVHGLKWIGALEPKTGDTAYSQKFKGKATLTADKSSSTAYMELRSLTSEDSAVYYCTSCYYYTYSGQGTLVTVSATREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5381 - protein, 723 aa, Artificial Sequence
  Synthetic Polypeptide encoding a CAR with optional accessory module(s)
MALPVTALLLPLALLLHAARPDIQLTQSPSSLSASVGDRVTITCRASQGIRNDLGWYQQKPGKAPKRLIYAASSLQNGVPSRFSGSGSGTEFTLTISSLQPEDFATYYCLQHNTYPAFGQGTKVEIKRGGGGSGGGGSGGGGSQVQLQESGPGLVKPSQTLSLTCTVSGGSISSFNYYWSWIRHHPGKGLEWIGYIYYSGSTYSNPSLKSRVTISVDTSKNQFSLTLSSVTAADTAVYYCARGYNWNYFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5382 - protein, 725 aa, Artificial Sequence
  Synthetic Polypeptide encoding a CAR with optional accessory module(s)
MALPVTALLLPLALLLHAARPDDIVLTQSPASLAVSLGQSVTISCRASESVEYYGTSLMQWYQQKPGQPPKLLIYATSNVESGVPARFSGSGSGTDFSLNIHPVEEDDIAMYFCQQSRKLPSTFGGGTKLEIKGGGGSGGGGSGGGGSDVRLQESGPGQVKPSQTVSLTCSVTGYSITNGNHWWNWIRQVSGSKLEWIGYISSSGSTDSNPSLKSRISITRDTSKNQLFLQLNSVTTEDIATYYCARGYYFDYWGQGTTLTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5383 - protein, 603 aa, Artificial Sequence
  Synthetic Polypeptide encoding a CAR with optional accessory module(s)
MALPVTALLLPLALLLHAARPDEFEVQLVESGGGLVQAGGSLRLSCAASGITFSINTMGWYRQAPGKQRELVALISSIGDTYYADSVKGRFTISRDNAKNTVYLQMNSLKPEDTAVYYCKRFRTAAQGTDYWGQGTQVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5384 - protein, 538 aa, Artificial Sequence
  Synthetic Polypeptide encoding a CAR with optional accessory module(s)
MDWIWRILFLVGAATGAHSFEGSGFEYAKEMRNAYWEIALLPNLTNQQKRAPIRKLYDDPSQSSELLSEAKKLNDSQTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5385 - protein, 609 aa, Artificial Sequence
  Synthetic Polypeptide encoding a CAR with optional accessory module(s)
MALPVTALLLPLALLLHAARPDEFGSDLGIKLLFAAAKGQDDEVRILLAAGADVNAKDFEGYTPLHVAAYDGHLEIVEVLLKAGADVNAKDSQGRTPLHEAAYSGHLEIVEVLLKAGADVNAQDDAGETPADLAAAWGHEDIAEVLQKTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5386 - protein, 608 aa, Artificial Sequence
  Synthetic Polypeptide encoding a CAR with optional accessory module(s)
MDWIWRILFLVGAATGAHSFERSDLGKKLLEAARAGQDDEVRILMANGADVNAKDEYGLTPLYLATAHGHLEIVEVLLKNGADVNAVDAIGFTPLHLAAFIGHLEIAEVLLKHGADVNAQDKFGKTAFDISIGNGNEDLAEILQKLNTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5387 - protein, 760 aa, Artificial Sequence
  Synthetic Polypeptide encoding a CAR with optional accessory module(s)
MALPVTALLLPLALLLHAARPDEFEVQLVESGGGLVQAGGSLRLSCAASGITFSINTMGWYRQAPGKQRELVALISSIGDTYYADSVKGRFTISRDNAKNTVYLQMNSLKPEDTAVYYCKRFRTAAQGTDYWGQGTQVTVSSLEGGGGSGGGGSGGGGSGSGGSGSGGSGSGGSGSGGSFEVQLVESGGGLVQPGGSLRLSCAASGSIFGFNDMAWYRQAPGKQRELVALISRVGVTSSADSVKGRFTISRVNAKDTVYLQMNSLKPEDTAVYYCYMDQRLDGSTLAYWGQGTQVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5388 - protein, 724 aa, Artificial Sequence
  Synthetic Polypeptide encoding a CAR with optional accessory module(s)
MALPVTALLLPLALLLHAARPDIQMTQSPSSLSASVGDRVTITCRASQDVNTAVAWYQQKPGKAPKLLIYSASFLESGVPSRFSGSRSGTDFTLTISSLQPEDFATYYCQQHYTTPPTFGQTKVEIKRGGGGSGGGGSGGGGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDVWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5389 - protein, 603 aa, Artificial Sequence
  Synthetic Polypeptide encoding a CAR with optional accessory module(s)
MALPVTALLLPLALLLHAARPDEFDVQLVESGGGLVQPGGSLRLSCAASGSIGGLNAMAWYRQAPGKERELVAGIFGVGSTRYADSVKGRFTISRDNSKNTVYLQMNSLRPEDTAVYYCRMSSVTRGSSDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5390 - protein, 543 aa, Artificial Sequence
  Synthetic Polypeptide encoding a CAR with optional accessory module(s)
MALPVTALLLPLALLLHAARPDEFVDNKFNKERYSAYYEIWQLPNLNVRQKAAFIGSLQDDPSQSANLLAEAKKLNDAQAPKTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5391 - protein, 765 aa, Artificial Sequence
  Synthetic Polypeptide encoding a CAR with optional accessory module(s)
MALPVTALLLPLALLLHAARPDEFDVQLVESGGGLVQPGGSLRLSCAASGSIGGLNAMAWYRQAPGKERELVAGIFGVGSTRYADSVKGRFTISRDNSKNTVYLQMNSLRPEDTAVYYCRMSSVTRGSSDYWGQGTLVTVSSLEGGGGSGGGGSGGGGSGSGGSGSGGSGSGGSGSGGSFEVQLVESGGSLVQPGGSLRLSCAASGFTFDDYAMSWVRQVPGKGLEWVSSINWSGTHTDYADSVKGRFTISRNNANNTLYLQMNSLKSEDTAVYYCAKNWRDAGTTWFEKSGSAGQGTQVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5392 - protein, 723 aa, Artificial Sequence
  Synthetic Polypeptide encoding a CAR with optional accessory module(s)
MALPVTALLLPLALLLHAARPDQSVLTQPPSVSVAPGKTARIPCEGNYIGSSNVHWYQQKPGQAPVLVIHFDSDRPSGIPDRFSGSNSGNMATLTISRVEAGDEADYYCQVWENHGWVFGGGTKLTVLSGGGGSGGGGSGGGGSEVQLVETGGGLVQPGESLRLSCAASGFTFSDYEMNWVRQAPGKGLEWVSYISSSGSTIYYADSVKGRFTIYRDNAKNSLYLQMNSLRAEDTALYYCARAWGVGPPDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5393 - protein, 731 aa, Artificial Sequence
  Synthetic Polypeptide encoding a CAR with optional accessory module(s)
MALPVTALLLPLALLLHAARPDIQMTQSPSSLSASVGDTVTITCQANGYLNWYQQRRGKAPKLLIYDGSKLERGVPSRFSGRRWGQEYNLTINNLQPEDIATYFCQVYEFVVPGTRLDLKRTVAAPGGGGSGGGGSGGGGSQVQLLQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTQVTVSSASTKGPTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5394 - protein, 737 aa, Artificial Sequence
  Synthetic Polypeptide encoding a CAR with optional accessory module(s)
MALPVTALLLPLALLLHAARPQSALTQPPSASGSPGQSITISCTGTSNNFVSWYQQHAGKAPKLVIYDVNKRPSGVPDRFSGSKSGNTASLTVSGLQTDDEAVYYCGSLVGNWDVIFGGGTKLTVLGGGGSGGGGSGGGGSQPQLQESGPTLVEASETLSLTCAVSGDSTAACNSFWGWVRQPPGKGLEWVGSLSHCASYWNRGWTYHNPSLKSRLTLALDTPKNLVFLKLNSVTAADTATYYCARFGGEVLRYTDWPKPAWVDLWGRGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5395 - protein, 722 aa, Artificial Sequence
  Synthetic Polypeptide encoding a CAR with optional accessory module(s)
MALPVTALLLPLALLLHAARPEIVLTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIKRGGGGSGGGGSGGGGSQVQLVQSGGQMKKPGESMRISCRASGYEFIDCTLNWIRLAPGKRPEWMGWLKPRGGAVNYARPLQGRVTMTRDVYSDTAFLELRSLTVDDTAVYFCTRGKNCDYNWDFEHWGRGTPVIVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5396 - protein, 732 aa, Artificial Sequence
  Synthetic Polypeptide encoding a CAR with optional accessory module(s)
MALPVTALLLPLALLLHAARPELVLTQSPGTLSLSAGERATLSCRASQSVSSGSLAWYQQKPGQAPRLLIYGASTRATGIPDRFSGSGSGTDFTLTIGRLEPEDLAVYYCQQYGTSPYTFGQGTKLEIGGGGSGGGGSGGGGSLEQSGAEVKKPGSSVQVSCKASGGTFSMYGFNWVRQAPGHGLEWMGGIIPIFGTSNYAQKFRGRVTFTADQATSTAYMELTNLRSDDTAVYYCARDFGPDWEDGDSYDGSGRGFFDFWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5397 - protein, 728 aa, Artificial Sequence
  Synthetic Polypeptide encoding a CAR with optional accessory module(s)
MALPVTALLLPLALLLHAARPDVVMTQSPSSLSASVGDRVTITCQSSLDISHYLNWYQQKPGKAPKLLIYDASNLETGVPSRFSGSGSGTHFTFTISSLQPEDFATYYCQQYDNLPLTFGGGTKLEIKRGGGGSGGGGSGGGGSQVQLVQSGGGVVQPGGSLRVSCAASGVTLSDYGMHWVRQAPGKGLEWVAFIRNDGSDKYYADSVKGRFTISRDNSEKTVSLQMSSLRAEDTAVYYCAKNGESGPLDYWYLDLWGRGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5398 - protein, 728 aa, Artificial Sequence
  Synthetic Polypeptide encoding a CAR with optional accessory module(s)
MALPVTALLLPLALLLHAARPDDIVMTQSQDSMATSVGERVTVNCKASQNVDTNVAWYQQKPGQSPEPLLFSASYRYTGVPDRFSGSGSGTDFTLTISSVQAEDVAEYFCQQYNSYPLTFGQGTKLEIKRGGGGSGGGGSGGGGSEVQVEVSGGGLVQPGGSMRLSCAVSGFTFSNYWMNWVRQSPEKGLEWIAEIRLKSNNFARYYAESVKGRFTISRDNSKNSLYLQMISLRAEDTAIYYCTSYGNYVGHYFDHWGQGTLLTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5399 - protein, 732 aa, Artificial Sequence
  Synthetic Polypeptide encoding a CAR with optional accessory module(s)
MALPVTALLLPLALLLHAARPSYELTQPPSVSGTPGQRVAISCSGSSSNIGTRMVTWYQHVPGTAPKLLIFNNNQRPSGVPDRFSASKSGTSASLAIIGLQSDDEADYYCATWDDNVKSYVFGTGTKVTVLGSRGGGGSGGGGSGGGGSLEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARAPQSWYVGDVWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5400 - protein, 729 aa, Artificial Sequence
  Synthetic Polypeptide encoding a CAR with optional accessory module(s)
MALPVTALLLPLALLLHAARPQSVLTQPPSLSVAPGKTASITCGGNNIGMKSVHWYQQRPGQAPVLVIYYDSDRPSGIPGRFSGSNSGNTATLTISRVEAGDEADYYCQVWDTTGDHPGYVFGTGTKVTVLGGGGSGGGGSGGGGSQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGVYGYSGSAPYDEWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5401 - protein, 735 aa, Artificial Sequence
  Synthetic Polypeptide encoding a CAR with optional accessory module(s)
MALPVTALLLPLALLLHAARPDEIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPRTFGQGTKVEIKRGGGGSGGGGSGGGGSQVQLVQSGGGVVQPGRSLRLSCAASGFTFSSYGMHWVRQAPGKGLEWVAVISYDGSNKYYADSVKGRFTISRDNSKNTLYLQMNSLRAEDTAVYYCARDFDYGDSYYYYGMDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5402 - protein, 729 aa, Artificial Sequence
  Synthetic Polypeptide encoding a CAR with optional accessory module(s)
MALPVTALLLPLALLLHAARPDEIVLTQSPATLSLSPGERATLSCRASQSVGSYLAWYQQKPGAPRLLIYDASHRATGIPARFSGSGSGTDFTLTISSLEPEDFAVYYCQQRSNWPPMYTFGQGTKLEIKRGGGGSGGGGSGGGGSEVQLVQSGAEVSVKVSCKASGGKKPGSTFSSYTISWVRQAPGQGLEWMGGIIPIFGTANYAQKFQGRVTITADKSTSTAYMELSSLRSEDTAVYYCAGDTDSSGYYGAVDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5403 - protein, 712 aa, Artificial Sequence
  Synthetic Polypeptide encoding a CAR with optional accessory module(s)
MALPVTALLLPLALLLHAARPDIQMTQSPSSLSASVGDRVTITCQASQDINNYLNWYQQKPGKAPKLLIYDASNLQTGVPSRFSGSGSGTDFTFTIEDIATYYCQQYTFGPGTKVDIKGGGGSGGGGSGGGGSEVQLLESGGGLVQPGGSLRLSCAASGFTFSWYSMTWVRQAPGKGLEWVSSIVPWGDFTQYADSVKGRFTISRDNSKNTLYLQMNSLRAEDTAVYYCAKGPGWGSFDLWGRGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5404 - protein, 601 aa, Artificial Sequence
  Synthetic Polypeptide encoding a CAR with optional accessory module(s)
MDWIWRILFLVGAATGAHSEVQLVESGGGLVQPGGSLRLSCAASGSVFKINVMAWYRQAPGKGRELVAGIISGGSTSYADSVKGRFTISRDNAKNTLYLQMNSLRPEDTAVYYCAFITTESDYDLGRRYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5405 - protein, 722 aa, Artificial Sequence
  Synthetic Polypeptide encoding a CAR with optional accessory module(s)
MALPVTALLLPLALLLHAARPDIQMTQSPSSLSASVGDRVTITCTASLSVSSTYLHWYQQKPGSSPKLWIYSTSNLASGVPSRFSGSGSGTSYTLTISSLQPEDFATYYCHQYHRSPLTFGGGTKVEIKRGGGGSGGGGSGGGGSEVQLVESGGGLVQPGGSLRLSCAASGFSLTKYGVHWVRQAPGKGLEWVGVKWAGGSTDYNSALMSRFTISKDNAKNSLYLQMNSLRAEDTAVYYCARDHRDAMDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5406 - protein, 726 aa, Artificial Sequence
  Synthetic Polypeptide encoding a CAR with optional accessory module(s)
MALPVTALLLPLALLLHAARPDIQMTQSPSSLSASVGDRVTITCKASQDVGTAVAWYQQKPGKAPKLLIYSASYRSTGVPSRFSGSGSGTDFTLTISSLQPEDFATYYCQHHYSAPWTFGGGTKVEIKGGGGSGGGGSGGGGSEVQLVESGGGLVQPGGSLRLSCAASGFTFSRNGMSWVRQAPGKGLEWVATVSSGGSYIYYADSVKGRFTISRDNAKNSLYLQMNSLRAEDTAVYYCARQGTTALATRFFDVWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5407 - protein, 732 aa, Artificial Sequence
  Synthetic Polypeptide encoding a CAR with optional accessory module(s)
MALPVTALLLPLALLLHAARPDIVMTQSPSSLTMSVGQKVTMSCKSSHSLLNSRNQKNYLAWFQQKPGQSPKLLVYFASTRESGVPDRFIGSGSGTDFTLTISNVQAEDLADYFCQQHYTTLPTFGGGTKLEIKGGGGSGGGGSGGGGSQIQLVQSGPDLKKPGETVKISCKASGYTFTNTGMNWVKQAPGKGLKWMGWINTYTGEPTYADDFKGRFTFSLETSASTAYLQINNLKNEDTATYFCTRWGYGSSLYYAMDYWGQGTSVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5408 - protein, 722 aa, Artificial Sequence
  Synthetic Polypeptide encoding a CAR with optional accessory module(s)
MALPVTALLLPLALLLHAARPDIQMTQSPPSLSASVGGKVTITCKASQDIDRYMAWYQDKPGKGPKLLIHDTSTLQPGIPSRFSGSGSGRDYSFSISNLEPEDIATYYCLQYDNLWTFGGGTKLEIKRGGGGSGGGGSGGGGSQVQLVQSGAELVKPGASVKMSCKASGYIFTNYNIHWVKKSPGQGLEWIGAIYPGNGDAPYSQKFQDRATLTADTSSSTTYMELSSLTSEDSAVYYCVRANWDVAFAYWGQGTLVSVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5409 - protein, 723 aa, Artificial Sequence
  Synthetic Polypeptide encoding a CAR with optional accessory module(s)
MALPVTALLLPLALLLHAARPDIQMTQSPASLSASVGETVTITCRVSGNIHNYLAWYQQKQGKSPQLLVYNAKTLADGVPSRFSGSGSGTQYSLKINSLQPEDFGSYYCQHFWSNPYTFGGGTKLEIKGGGGSGGGGSGGGGSQVQLQQSGASVKVSCKASELVRPGTGYAFTNYLIEWVKQRPGQGLEWIGVINPGSGGTNYNEKFKGKATLTADKSSSTAYMQLSSLTSDDSAVYFCARYRSYDWYFDVWGAGTTVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5410 - protein, 728 aa, Artificial Sequence
  Synthetic Polypeptide encoding a CAR with optional accessory module(s)
MALPVTALLLPLALLLHAARPDDIQMTQSPSSLSASVGDRVTITCRSSQRIVHSNGNTYLEWYQQTPGKAPKLLIYKVSNRFSGVPSRFSGSGSGTDYTPTISSLQPEDIATYYCFQGSHVPPTFGQGTKLQITGGGGSGGGGSGGGGSEVQLVESGGGVVQPGRSLRLSCSSSGPTFSDYYMYWVRQAPGKGLEWVAYMSNVGAITDYPDTVKGRPTISRDNSKNTLFLMDSLRPEDTGVYFCARGTRDGSWFAYWGQGTPVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5411 - protein, 722 aa, Artificial Sequence
  Synthetic Polypeptide encoding a CAR with optional accessory module(s)
MALPVTALLLPLALLLHAARPDIQMTQSFSSLSASVGDRVTITCRASQDISNYLNWYQQKPGKAPKLLIYYTSRLHSGVPSRFSGSGSGTDYTLTISSLQPEDFATYFCQQGNTLPWTFGGGTKLEIKRGGGGSGGGGSGGGGSEVQLVQSGGGLVQSGGSLRLSCRASGYTFTRYWMLWVRQRPGKGLEWVAEINPRNDRTNYNEKFKTRFTISVDRSKNTLYLQMDSLRAEDTAVYFCALGGGYAMDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5412 - protein, 709 aa, Artificial Sequence
  Synthetic Polypeptide encoding a CAR with optional accessory module(s)
MEMLQGLLLLLLLSMGGAWASREPLRPWCHPINAILAVEKEGCPVCITVNTTICAGYCPTMMRVLQAVLPPLPQVVCTYRDVRFESIRLPGCPRGVDPVVSFPVALSCRCGPCRRSTSDCGGPKDHPLTCDHPQLSGLLFLGGGGSGGGGSGGGGSAPDVQDCPECTLQENPFFSQPGAPILQCMGCCFSRAYPTPLRSKKTMLVQKNVTSESTCCVAKSYNRVTVMGGFKVENHTACHCSTCYYHKSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5413 - protein, 723 aa, Artificial Sequence
  Synthetic Polypeptide encoding a CAR with optional accessory module(s)
MALPVTALLLPLALLLHAARPDIQMTQSPASLSASVGETVTIICRASVNIYSYLAWYQQKQGKSPQLLVYNAKILAEGVPSRFSGSGSGTQFSLKINSLQPEDFGSYYCQHHYGTFTFGSGTKLEIKRGGGGSGGGGSGGGGSQVQLKESGPGLVAPSQSLSITCTISGFSLTSYGVHWVRQPPGKGLEWLVVIWSDGSTTYNSALKSRLSISKDNSKSQVFLKMNSLQTDDTAIYYCASHYGSTLAFASWGHGTLVTVSAATREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5414 - protein, 731 aa, Artificial Sequence
  Synthetic Polypeptide encoding a CAR with optional accessory module(s)
MALPVTALLLPLALLLHAARPDIVMTQSHKFMSTSVGDRVSVTCKASQNVGNNVAWYQQKPGQSPKVLIYSASYRYSGVPDRFTGSGSGTDFTLTISNVQSEDLAEYFCQQYNTYPFTFGSGTKLEIKGGGGSGGGGSGGGGSEVQLEESGGGLVQPGGSMKLSCVASGFTFSNYWMNWVRQSPEKGLEWVAEIRFKSHNYATHFAESVKGRFTISRDDSKSSVYLQMNNLRAEDTGIYYCTRRIGNSDYDWWYFDVWGAGTSVTVSSASTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5415 - protein, 727 aa, Artificial Sequence; identical to SEQ ID NO: 5300
  Synthetic Polypeptide encoding a CAR with optional accessory module(s)

SEQ ID NO: 5416 - protein, 733 aa, Artificial Sequence
  Synthetic Polypeptide encoding a CAR with optional accessory module(s)
MALPVTALLLPLALLLHAARPDQSVLTQPPSVSGAPGQRVTISCTGSSSNIGAGYDVHWYQQLPGTAPKLLIYGNSNRPSGVPDRFSGSKSGTSASLAITGLQAEDEADYYCQSYDNSLSSWVFGGGTKLTVLGQPKGGGGSGGGGSGGGGSEVQLQQSGAEVKKPGSSVKVSCKASGGTFSSYAISWVRQAPGQGLEWMGRIIPILGIANYAQKFQGRVTITADKSTSTAYMELSSLRSEDTAVYYCARDVGSGSYSLDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5417 - protein, 730 aa, Artificial Sequence
  Synthetic Polypeptide encoding a CAR with optional accessory module(s)
MALPVTALLLPLALLLHAARPDQSVVTQPPSVSAAPGRKVTISCSGSSSNIGSNYVSWYQQVPGTAPKLLIYEDDKRPSGIPDRFSGSKSGTSATLGITGLQTGDEADYFCATWDRTVNVVRFGGGTRLTVHSQPKGGGGSGGGGSGGGGSQLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARHVGHELDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5418 - protein, 724 aa, Artificial Sequence
  Synthetic Polypeptide encoding a CAR with optional accessory module(s)
MALPVTALLLPLALLLHAARPDIQMTQSPSSLSASVGDRVTITCRASQSISSYLNWYQQKPGKAPKLLIYAASSLQSGVPSGFSGSGSGTDFTLTISSLQPEDFATYYCQQSYSTPLTFGGGTKVEIKRGGGGSGGGGSGGGGSQVQLQESGPGLVKPSETLSLTCTVSGGSVSSGSYYWSWIRQPPGKGLEWIGYIYYSGSTNYNPSLKSRVTISVDTSKNQFSLKLSSVTAADTAVYYCAREGKNGAFDIWGQGTMVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5419 - protein, 610 aa, Artificial Sequence
  Synthetic Polypeptide encoding a CAR with optional accessory module(s)
MALPVTALLLPLALLLHAARPDEFDVQLVESGGGLVQPGGSLRLSCAASGFILDYYAIGWFRQAPGKEREGVLCIDASDDITYYADSVKGRFTISRDNSKNTVYLQMNSLRPEDTAVYYCATPIGLSSSCLLEYDYDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5420 - protein, 773 aa, Artificial Sequence
  Synthetic Polypeptide encoding a CAR with optional accessory module(s)
MALPVTALLLPLALLLHAARPDEFDVQLVESGGGLVQPGGSLRLSCAASGFILDYYAIGWFRQAPGKEREGVLCIDASDDITYYADSVKGRFTISRDNSKNTVYLQMNSLRPEDTAVYYCATPIGLSSSCLLEYDYDYWGQGTLVTVSSLEGGSGSGGGGSGGGGSGSGGSGSGGSGSGGSGSGGSFEVQLVESGGGLVQPGGSLRLSCAASGRTYYLNAMGWFRQAPGKEREFVAAIDWSEGNKDYADSVKGRFTISRDNSKNTVYLQMNSLRPEDTAVYYCAADTPPWGPLIYIESYDSWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5421 - protein, 724 aa, Artificial Sequence
  Synthetic Polypeptide encoding a CAR with optional accessory module(s)
MALPVTALLLPLALLLHAARPDQIVLTQSPAIMSASPGEKVTISCSASSSVSYMYWYQQKPGSSPKPWIYRTSNLASGVPARFSGSGSGTSYSLTISNMEAEDAAAYYCQQYHSYPTTFGGGTKLEVKGGGGSGGGGSGGGGSEVQLVESGGGLVQPKGSLKLSCAASGFSFNTYAMNWVRQAPGKGLEWIAHIRSKSNNFATYYADSVKDRFSISRDASENILFLQMNNLKTEDTAMYYCVRQGGDFPMDYWGQGTSVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5422 - protein, 723 aa, Artificial Sequence
  Synthetic Polypeptide encoding a CAR with optional accessory module(s)
MALPVTALLLPLALLLHAARPDDIQMTQSSSSFSVSLGDRVTITCMASEDIYIRLAWYQQKPGNAPRLLISAATSLETGVPSRFSGSGSGKDYTLSITSLQTEDVGTYYCQQYWSSPWTFGGGTKLEINGGGGSGGGGSGGGGSDVQLQESGPGLVKPSQSLSLTCTVTGYSITSDYTWNWIRQFPGNKLEWMGYITYSGSTSYNPSLKSRNSITRDTSKNQFFLQLNSVTTEDTATYYCARLGRRYTMDYWGQGTSVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5423 - protein, 722 aa, Artificial Sequence
  Synthetic Polypeptide encoding a CAR with optional accessory module(s)
MALPVTALLLPLALLLHAARPDVQLQESGPGLVKPSQSLSLTCTVTGYSITSDYTWNWIRQFPGNKLEWMGYITYSGSTSYNPSLKSRNSITRDTSKNQFFLQLNSVTTEDTATYYCARLGRRYTMDYWGQGTSVTVSSGGGGSGGGGSGGGGSDIQMTQSSSSFSVSLGDRVTITCMASEDIYIRLAWYQQKPGNAPRLLISAATSLETGVPSRFSGSGSGKDYTLSITSLQTEDVGTYYCQQYWSSPWTFGGGTKLEINTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5424 - protein, 723 aa, Artificial Sequence
  Synthetic Polypeptide encoding a CAR with optional accessory module(s)
MALPVTALLLPLALLLHAARPDIQMTQSSSSFSVSLGDRVTITCKASEDIYIRLAWYQQKPGNAPRLLISAATSLETGIPSRFSGSGSGEDYTLTITSLQTEDVATYYCQQYWTTPWTFGGGTKLEIKRGGGGSGGGGSGGGGSDVQLQESGPGLVKPSQSLSLTCTVTGYSITIDYTWNWIRQFPGNKLEWMGYITYSGSTDYNPSLKSRSSITRDTSMNQFFLQLNSVTTEDTATYYCARLGRRYALDYWGQGTSVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5425 - protein, 724 aa, Artificial Sequence
  Synthetic Polypeptide encoding a CAR with optional accessory module(s)
MALPVTALLLPLALLLHAARPDIVMTQAAPSIPVTPGESVSISCRSDKSLLHSNGNTYLFWFLQRPGQSPQLLIYRMSNLASGVPDRFSGSGSGTAFTLRISGVEAEDVGVYYCMQHLEYPYTFGGGTKLEIKGGGGSGGGGSGGGGSQVQLQQSGPELVKPGASVKMSCKASGYAFSSSWLNWVRQRPGKGLEWIGRIYPGDGENHYNGKFKGKATLTADKSSSTGYMQLSSLTSEDSAVYFCASYYEGGYWGQGTLITVSATREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5426 - protein, 723 aa, Artificial Sequence
  Synthetic Polypeptide encoding a CAR with optional accessory module(s)
MALPVTALLLPLALLLHAARPDIVLTQSPASLAVSLGQSVTISCRASESVEYYGTSLMQWYQQKPGQPPKLLIYGASNVESGVPARFSGSGSGTDFSLNIHPVEEDDIAMYFCQQSRKVPWTFGGGTKLEIKGGGGSGGGGSGGGGSEVKLVESGGGLVKPGGSRKLSCAASGFTFSSYTMSWVRQTPAKRLEWVATISSGSSTIYYADTVKGRFTISRDNAKNTLFLQMTSLRSEDTAMYYCARRWFLDCWGQGTTLTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5427 - protein, 726 aa, Artificial Sequence
  Synthetic Polypeptide encoding a CAR with optional accessory module(s)
MALPVTALLLPLALLLHAARPDQVQLQQSGPGLVKPSETLSLTCTVSGDSISSYYWSWIRQPPGKGLEWIGYIYYSGSTNYNPSLKSRVTISVDTSKSQFSLKLSSVTAADTAVYYCARGRYFDVWGRGTMVTSSGGGGSGGGGSGGGGSSSYVLTQPPSVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLGAAATREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5428 - protein, 727 aa, Artificial Sequence
  Synthetic Polypeptide encoding a CAR with optional accessory module(s)
MALPVTALLLPLALLLHAARPDIVMTQSPLSLPVTPGEPASISCRSSKSLLHSNGNTYLYWFQQKPGQAPRLLIYRMSNLASGVPDRFSGSGSGTAFTLKISRVEAEDVGVYYCMQHIEYPFTFGQGTKLEIKGGGGSGGGGSGGGGSQVQLVQSGPEVKKPGASVKVSCKASGYTFTNSWMNWVRQRPGKGLEWIGRIYPGDGETIYNGKFRVRVTITADESTSTAYMELSSLRSEDTAVYYCARGYDDYSFAYWGQGTTVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5429 - protein, 727 aa, Artificial Sequence
  Synthetic Polypeptide encoding a CAR with optional accessory module(s)
MALPVTALLLPLALLLHAARPDEIVMTQSPATLSLSPGERATLSCRASQSVSSYLAWYQQKPGQAPRLLIYDASNRATGIPARFSGSGSGTDFTLTISSLEPEDFAVYYCHQYGSSPQTFGQGTKVEIKRGGGGSGGGGSGGGGSEVQLVQSGAEVKKPGSSVKVSCKASGGTFSSYAISWVRQAPGQGLEWMGGIIPIFGTANYAQKFQGRVTITADESTSTAYMELSSLRSEDTAVYYCAVHYGDYVFSSMDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5430 - protein, 730 aa, Artificial Sequence
  Synthetic Polypeptide encoding a CAR with optional accessory module(s)
MALPVTALLLPLALLLHAARPDETTLTQSPGTLSLSPGERATLSCRASQSVSSSYLAWYQQKPGQAPRLLIYGASSRATGIPDRFSGSGSGTDFTLTISRLEPEDFAVYYCQQYGSSPRTFGQGTKVEIKRGGGGSGGGGSGGGGSEVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGPEYCINGVCSLDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5431 - protein, 732 aa, Artificial Sequence
  Synthetic Polypeptide encoding a CAR with optional accessory module(s)
MALPVTALLLPLALLLHAARPDIELTQSPSSLAVSAGEKVTMSCKSSQSLLNSRTRKNQLAWYQQKPGQSPELLIYWASTRQSGVPDRFTGSGSGTDFTLTISSVQAEDLAVYYCQQSYNLLTFGPGTKLEVKRGGGGSGGGGSGGGGSVKLQESGGGFVKPGGSLKVSCAASGFTFSSYAMSWVRLSPEMRLEWVATISSAGGYIFYSDSVQGRFTISRDNAKNTLHLQMGSLRSGDTAMYYCARQGFGNYGDYYAMDYWGQGTTVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5432 - protein, 731 aa, Artificial Sequence
  Synthetic Polypeptide encoding a CAR with optional accessory module(s)
MALPVTALLLPLALLLHAARPDIQMTQSPSSLSASVGDRVTITCRSSQNIVHSNGNTYLDWYQQTPGKAPKLLIYKVSNRFSGVPSRFSGSGSGTDFTFTISSLQPEDIATYYCFQYSHVPWTFGQGTKLQIGGGGSGGGGSGGGGSQVQLQQSGAEVKKPGSSVKVSCKASGYTFTNYYIYWVRQAPGQGLEWIGGINPTSGGSNFNEKFKTRVTITADESSTTAYMELSSLRSEDTAFYFCTRQGLWFDSDGRGFDFWGQGTTVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5433 - protein, 627 aa, Artificial Sequence
  Synthetic Polypeptide encoding a CAR with optional accessory module(s)
MALPVTALLLPLALLLHAARPLFNQEVQIPLTESYCGPCPKNWICYKNNCYQFFDESKNWYESQASCMSQNASLLKVYSKEDQDLLKLVKSYHWMGLVHIPTNGSWQWEDGSILSPNLLTIIEMQKGDCALYASSFKGYIENCSTPNTYICMQRTVGGGGSGGGGDTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5434 - protein, 721 aa, Artificial Sequence
  Synthetic Polypeptide encoding a CAR with optional accessory module(s)
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIKRGGGGSGGGGSGGGGSQVHLQESGPGLVKPSETLSLTCTVSDDSISSYYWSWIRQPPGKGLEWIGHISYSGSANYNPSLKSRVTISVDTSKNQFSLKLSSVTAADTAVYYCANWDDAFNIWGQGTMVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5435 - protein, 723 aa, Artificial Sequence
  Synthetic Polypeptide encoding a CAR with optional accessory module(s)
MALPVTALLLPLALLLHAARPDVVMTQTPLTLSVTIGQPASISCKSSQSLLDSDGKTYLHWLLQRPGQSPKRLIFLVSKLDSGVPDRFTGSGSGTDFTLKISRVEAEDLGVYYCWQGTHFPQTFGGGTKLEIKGGGGSGGGGSGGGGSVQLQESGPDLVKPSQSLSLTCTVTGYSITSGYSWHWIRQFPGNKLEWMGYIHYSGDTDYNPSLKSRFSITRDTSKNQFFLQLNSVTTEDTATYYCATPGGFVYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5436 - protein, 727 aa, Artificial Sequence
  Synthetic Polypeptide encoding a CAR with optional accessory module(s)
MALPVTALLLPLALLLHAARPDQSELTQPRSVSGSPGQSVTISCTGTERDVGGYNYVSWYQQHPGKAPKLIIHDVIERSSGVPDRFSGSKSGNTASLTISGLQAEDEADYYCWSFAGGYYVFGTGTDVTVLGGGGSGGGGSGGGGSFEVQLLESGGGLVQPGGSLRLSCAASGFTFSTYQMSWVRQAPGKGLEWVSGIVSSGGSTAYADSVKGRFTISRDNSKNTLYLQMNSLRAEDTAVYYCAGELLPYYGMDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5437 - protein, 726 aa, Artificial Sequence
  Synthetic Polypeptide encoding a CAR with optional accessory module(s)
MALPVTALLLPLALLLHAARPDQSELTQPRSVSGSPGQSVTISCTGTERDVGGYNYVSWYQQHPGKAPKLIIHDVIERSSGVPDRFSGSKSGNTASLTISGLQAEDEADYYCWSFAGGYYVFGTGTDVTVLGGGGSGGGGSGGGGSEVQLLESGGGLVQPGGSLRLSCAASGFTFSTYEMHWVRQAPGKGLEWVSVILSSGGETNYADSVKGRFTISRDNSKNTLYLQMNSLRAEDTAVYYCAGMLLPYYGMDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5438 - protein, 628 aa, Artificial Sequence
  Synthetic Polypeptide encoding a CAR with optional accessory module(s)
MALPVTALLLPLALLLHAARPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5439 - protein, 723 aa, Artificial Sequence
  Synthetic Polypeptide encoding a CAR with optional accessory module(s)
MALPVTALLLPLALLLHAARPDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRGGGGSGGGGSGGGGSEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5440 - protein, 724 aa, Artificial Sequence
  Synthetic Polypeptide encoding a CAR with optional accessory module(s)
MALPVTALLLPLALLLHAARPAIVMTQTPSPVSAAVGGTVTINCQASESVYSNNYLSWFQQKPGQPPKLLIYLASTLASGVPSRFKGSGSGTQFTLTISGVQCDDAATYYCIGGKSSSTDGNAFGGGTEVVVRGGGGSGGGGSGGGGSQSLEESGGRLVKPDETLTITCTVSGIDLSSNGLTWVRQAPGEGLEWIGTINKDASAYYASWAKGRLTISKPSSTKVDLKITSPTTEDTATYFCGRIAFKTGTSIWGPGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5441 - protein, 722 aa, Artificial Sequence
  Synthetic Polypeptide encoding a CAR with optional accessory module(s)
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKGGGGSGGGGSGGGGSQVQLVQSGAEVKKPGASVKVSCKASGYTFTSYDVHWVRQAPGQRLEWMGWLHADTGITKFSQKFQGRVTITRDTSASTAYMELSSLRSEDTAVYYCARERIQLWFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5442 - protein, 741 aa, Artificial Sequence
  Synthetic Polypeptide encoding a CAR with optional accessory module(s)
MALPVTALLLPLALLLHAARPDDIVMTQSPLSLPVTPGEPASISCRSSQSLLHSNGYNYLVWYLQKPGQSPQLLIYLGSIRASGVPDRFSGSGSGTDFTLKISRVEAEDVGVYYCMQPLQTPITFGQGTRLEIKRGGGGSGGGGSGGGGSGLQCVAAPRWVLSQVQLQQWGAGLLKPSETLSLTCAVYGGSFSGNYWSWIRQPPGKGLEWIGEINHSGSTNYNPSLKSRVTISVDTSKNQFSLKLSSVTAADTAVYYCARGGSYNYFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5443 - protein, 738 aa, Artificial Sequence
  Synthetic Polypeptide encoding a CAR with optional accessory module(s)
MALPVTALLLPLALLLHAARPDQLTQSPSSVSASVGDRVTITCRASRGISSWLAWYQQKPGKAPKLLIYTASSLQSGVPSRFSGSGSGTDFTLTISSLQPEDFATYYCQQAYSFPRTFGQGTKVEIKRGGGGSGGGGSGGGGSVAAPRWVLSQVQLQESGPGLVKPSQTLSLTCTVSGGSISSGGYYWIWIRQHPGKGLEWIGYIYYNGNTYYNPSLKSRVTMSVDTSKNQFSLKLSSVTAADTAVYYCARDGITMIRGYYYGMDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5444 - protein, 712 aa, Artificial Sequence
  Synthetic Polypeptide encoding a CAR with optional accessory module(s)
MALPVTALLLPLALLLHAARPDIVVTQSPASLAVSLGQRATISYRASKSVSTSGYSYMHWNQQKPGQPPRLLIYLVSNLESGVPARFSGSGSGTDFTLNIHPVEEEDAATYYCQHIRELTRSEGGPSWKGGGGSGGGGSGGGGSEVKLEESGGDLVKPGGSLKLSCAASGFTFSGYGMSWVRQTPDKRLEWVATISSGGSYTYYPDSVKGRFTISRDNAKNTLYLQMSSLKSEDTAMYYCARHEGGYYGSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5445 - protein, 728 aa, Artificial Sequence
  Synthetic Polypeptide encoding a CAR with optional accessory module(s)
MALPVTALLLPLALLLHAARPDDIQMTQSPSSLSASVGDRVTITCRASQGISNYLAWYQQKTGKVPKFLIYEASTLQSGVPSRFSGGGSGTDFTLTISSLQPEDVATYYCQNYNSAPFTFGPGTKVDIKGGGGSGGGGSGGGGSQVQLVESGGGVVQPGRSLRLSCAASGFAFSRYGMHWVRQAPGKGLEWVAVIWYDGSNKYYADSVKGRFTISRDNSKNTQYLQMNSLRAEDTAVYYCARGGDFLYYYYYGMDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5446 - protein, 719 aa, Artificial Sequence
  Synthetic Polypeptide encoding a CAR with optional accessory module(s)
MALPVTALLLPLALLLHAARPDIQMTQSPSSLSTSVGDRVTLTCKASQDVGTAVDWYQQKPGPSPKLLIYWASTRHTGIPSRFSGSGSGTDFTLTISSLQPEDFADYYCQQYNSYPLTFGPGTKVDIKGGGGSGGGGSGGGGSEVQLVQSGPEVKKPGATVKISCKTSGYTFTEYTIHWVKQAPGKGLEWIGNINPNNGGTTYNQKFEDKATLTVDKSTDTAYMELSSLRSEDTAVYYCAAGWNFDYWGQGTLLTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5447 - protein, 720 aa, Artificial Sequence
  Synthetic Polypeptide encoding a CAR with optional accessory module(s)
MALPVTALLLPLALLLHAARPDIQMTQSPSSLSASVGDRVTITCKASQDIYPYLNWFQQKPGKAPKTLIYRTNRLLDGVPSRFSGSGSGTDFTFTISSLQPYYCLQYDEFPLTFGAGTKLEIKRGGGGSGGGGSGGGGSQITLKESGPTLVKPTQTLTLTCTFSGFSLSTSNMGVGWIRQPPGKALEWLAHIWWDDDKYYSPSLKSRLTITKDTSKNQVVLTMTNMDPVDTATYYCVRSNYGYAWFAYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5448 - protein, 720 aa, Artificial Sequence
  Synthetic Polypeptide encoding a CAR with optional accessory module(s)
MALPVTALLLPLALLLHAARPDIVMTQSQKFMSTSVGDRVNVTCKASQNVGTNVVWYQQKTGQSPKALIHSASYRYSGVPDRFTGSGSGTDFTLTLSNVQSEDLAEYFCQHYNSFPYTFGGGTKLEIKRGGGGSGGGGSGGGGSQVQLQQSGAELVRPGVSVKISCKGSGYRFTDYPIHWVKQSHAKSLEWIGIISTYYGDVTNNPKFRGKATMTVDKSSTTAYMELARLTSEDSAIYYCARNDLFAYWGQGTLVTVSATREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5449 - protein, 723 aa, Artificial Sequence
  Synthetic Polypeptide encoding a CAR with optional accessory module(s)
MALPVTALLLPLALLLHAARPDIKMTQSPSSMYASLGERVTITCKASPDINSYLSWFQQKPGKSPKTLIYRANRLVDGVPSRFSGGGSGQDYSLTINSLEYEDMGIYYCLQYDEFPYTFGGGTKLEMKGGGGSGGGGSGGGGSEVKLVESGGGLVKPGGSLKLSCAASGFTFSSYAMSWVRQIPEKRLEWVASISRGGTTYYPDSVKGRFTISRDNVRNILYLQMSSLRSEDTAMYYCGRYDYDGYYAMDYWGQGTSVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5450 - protein, 726 aa, Artificial Sequence
  Synthetic Polypeptide encoding a CAR with optional accessory module(s)
MALPVTALLLPLALLLHAARPDDVVVTPVSCFLSCISGAEGHHLIQGQQKCQYIWLLYALEPTETRTATQTPHLSCIQPRIWGPCQVQWQWVWDRLHPQHPSCGGGGCCNLLLSAHGAYTFGGGTRLELKGGGGSGGGGSGGGGSEVKLQESGPELVKPGASVKMSCKASGYTFTSYVMHWVKQKPGQGLEWIGYINPYNDGTKYNEKFKGKATLTSDKSSSTAYMELSSLTSEDSAVYYCARWKIYYGNYEDYWGQGTPLTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5451 - protein, 756 aa, Artificial Sequence
  Synthetic Polypeptide encoding a CAR with optional accessory module(s)
MALPVTALLLPLALLLHAARPDEFQVQLVQSGGGLVQPGGSLRLSCAASDFDFAAYEMSWVRQAPGQGLEWVAIISHDGIDKYYTDSVKGRFTISRDNSKNTLYLQMNTLRAEDTATYYCLRLGAVGQGTLVTVSSLEGGGGSGGGGSGGGGSGSGGSGSGGSGSGGSGSGGSFEQVQLVQSGGGLVQPGGSLRLSCAASDFAFDDYEMSWVRQAPGKALEWIGDINHSGTTIYNPSLKSRVTISRDNSKNTLYLQMNTLRAEDTAIYYCARPHYGDYSDAFDIWGQGTMVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5452 - protein, 731 aa, Artificial Sequence
  Synthetic Polypeptide encoding a CAR with optional accessory module(s)
MALPVTALLLPLALLLHAARPEIVMTQSPATLSVSPGERATLSCRASQSVSSNLAWYQQKPGQAPRLLIYGASTRATGIPARFSGSGSGTDFTLTISSLQSVDSAVYYCQQYNNWPPYTFGQGTKLEIKGGGGSGGGGSGGGGSQVQLLESGGGVVQPGRSLRLSCAASGFTFSFYGMHWVRQAPGKGLEWVAAISYDGSNKYYADSVKGRFTISRDNSKNTLYLQMNSLRAEDTAVYYCAKRPNQFYCSDGRCYSIDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5453 - protein, 727 aa, Artificial Sequence
  Synthetic Polypeptide encoding a CAR with optional accessory module(s)
MALPVTALLLPLALLLHAARPQSVLTQPPSASAGGTPGQRVTISCSGSSSNIGSNFVYWYQQLPGTAPKLLIYRNNQRPSGVPDRFSGSRSGTSASLAGLRSEDEADYYCAADSLGGHYVFGTGTKVLGGGGSGGGGSGGGGSQVQLVESGGGSVQPGRSLRLSCEASGFTFEAYAMHWVRQPPGKGLEWVSSINWNSGRIAYADSVKGRFTISRDNARNSLYLQMNSLRLEDTAFYYCAKDIRRFSTGGAEFEYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5454 - protein, 722 aa, Artificial Sequence
  Synthetic Polypeptide encoding a CAR with optional accessory module(s)
MALPVTALLLPLALLLHAARPENVLTQSPAIMSASPGEKVTMTCSASSSVSYMHWYQQKSSTSPKLWIYDTSKLASGVPGRFSGSGSGNSYSLTISSMEAEDVATYYCFQGSGYPLTFGAGTKLELKGGGGSGGGGSGGGGSQVQLKESGPGLVAPSQSLSITCTVSGFSLSSQGVYWVRQPPGKGLEWLGAIWAGGSTNYNSALMSRLSISKDNSKSQVFLKMNSLQTDDTAMYYCARVDGYRGYNMDYWGQGTSVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5455 - protein, 726 aa, Artificial Sequence
  Synthetic Polypeptide encoding a CAR with optional accessory module(s)
MALPVTALLLPLALLLHAARPDDIQMTQSPSSLSASVGDRVTITCRASQSISSYLNWYQQKPGKAPKLLIYDASNLETGVPSRFSGSGSGTDFTFTISSLQPEDIATYYCQQYDNLPLTFGGGTKVDIKRGGGGSGGGGSGGGGSQVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARAHNSSSWSFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5456 - protein, 735 aa, Artificial Sequence
  Synthetic Polypeptide encoding a CAR with optional accessory module(s)
MALPVTALLLPLALLLHAARPDDVVMTQSPLSLPVSLGDQASISCRSSQRLVHSNGNTYLHWYLQKPGQSPKLLIYRVSNRFPGVPDRFSGSGSGTDFTLKISRVEAEDLGIYFCSQSTHVPYTFGGGTKLEIKRGGGGSGGGGSGGGGSEVRLQQSGPDLIKPGASVKMSCKASGYTFTGYVMHWVKQRPGQGLEWIGFINPYNDDIQSNERFRGKATLTSDKSSTTAYMELSSLTSEDSAVYYCARGAGYNFDGAYRFFDFWGQGTTLTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5457 - protein, 726 aa, Artificial Sequence
  Synthetic Polypeptide encoding a CAR with optional accessory module(s)
MALPVTALLLPLALLLHAARPDSYELTQPPSVSVSPGQTATISCSGDQLGGKYGHWYQKKPGQSPVLVLYQDRKRPAGIPERFSGSSSGNTITLTISGTQAVDEADYYCQAWDTNLGGVFGGGTKVTVLGQGGGGSGGGGSGGGGSQVQLVESGAEVKKPGASVKVSCKASGYTFTGYYMHWVRQAPGQGLEWMGRINPNSGGTNYAQKFQGRVTMTRDTSISTAYMELSRLRSDDTAVYYCASPRGRGSAFDIWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5458 - protein, 729 aa, Artificial Sequence
  Synthetic Polypeptide encoding a CAR with optional accessory module(s)
MALPVTALLLPLALLLHAARPDNFMLTQPHSVSESPGKTVTISCTRSSGSIASKYVQWYQQRPGSSPTTVIYEDNQRPSGVPDRFSGSIDTSSNSASLTISGLRTEDEADYYCHSYDSNNHSVFGGGTKVTVLGQGGGGSGGGGSGGGGSEVQLVESGGGVVQPGGSLRLSCAASGFTFSSYAMSWVRQAPGKGLEWVSAISGSGGSTYYADSVKGRFSISRDNSKNTLYLQMNSLRAEDTAVYYCARTRSSGAFDIWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5459 - protein, 724 aa, Artificial Sequence
  Synthetic Polypeptide encoding a CAR with optional accessory module(s)
MALPVTALLLPLALLLHAARPDIQMNQSPSSLSASLGDTITITCHASQNINVWLSWYQQKPGNIPKLLIYKASNLHTGVPSRFSGSGSGTGFTITISSLQPEDIATYYCQQGQSYPWTFGGGTKLEIKRGGGGSGGGGSGGGGSEVQLQQSGPELVKPGASVKISCKASGYSFTGYFMNWVKQSHGKSLEYIGRFNPYNGETLYNQKFKGKATLTVDKSSSTVHMELLSVTSEDSAVYYCGRSGNDDAMDYWGQGTSVTVSSATREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5460 - protein, 725 aa, Artificial Sequence
  Synthetic Polypeptide encoding a CAR with optional accessory module(s)
MALPVTALLLPLALLLHAARPDDIQMTQSPSILSASVGDRVTITCRASQRFGDYLAWYQQKPGQAPKLLIYGASTLQSGVPSRFSGSGSGTEFTLTISGLQPEDFATYYCQQANSFPITFGKGTRLDIRRGGGGSGGGGSGGGGSQVQLVQSGAEVKKPGSSVKVSCKASGGTFSSYAISWVRQAPGQGLEWMGWINVGNGNAIYSQKFQGRVTITRDTSATTAYMELSSLRSEDTAVYYCARDGERAWDLDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5461 - protein, 730 aa, Artificial Sequence
  Synthetic Polypeptide encoding a CAR with optional accessory module(s)
MALPVTALLLPLALLLHAARPDETTLTQSPGTLSLSPGERATLSCRASQSVSSSYLAWYQQKPGQAPRLLIYGASSRATGIPDRFSGSGSGTDFTLTISRLEPEDFAVYYCQQYGSSPYTFGQGTKLEIKRGGGGSGGGGSGGGGSQVQLVQSGGGVVQPGRSLRLSCAASGFTFSSYAMHWVRQAPGKGLEWVAVISYDGSNKYYADSVKGRFTISRDNSKNTLYLQMNSLRAEDTAVYYCARELRFLEWSSDAFDIWGQGTMVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5462 - protein, 725 aa, Artificial Sequence
  Synthetic Polypeptide encoding a CAR with optional accessory module(s)
MALPVTALLLPLALLLHAARPEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKGGGGSGGGGSGGGGSQLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPTMIRGVIDSWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5463 - protein, 722 aa, Artificial Sequence
  Synthetic Polypeptide encoding a CAR with optional accessory module(s)
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKGGGGSGGGGSGGGGSQVQLVQSGAEVRKPGSSVKVSCKASGGSFNNYPIFWVRQAPGQGFEWMGRIIPILGITAYAQKFQGRVTITADKSTSTAYMELNSLRSEDTAVYYCAGGDDLDAFDIWGQGTMVSVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5464 - protein, 734 aa, Artificial Sequence
  Synthetic Polypeptide encoding a CAR with optional accessory module(s)
MALPVTALLLPLALLLHAARPDIVMTQTPLSLPVTPGEPASISCRSSRSLLDSDDGNTYLDWYLQKPGQSPQLLIYTLSYRASGVPDRFSGSGSGTDFTLKISRVEAEDVGVYYCMQRVEFPITFGQGTRLEIKRGGGGSGGGGSGGGGSQVQLVESGGGVVQPGRSLRLSCAASGFIFSRYGMHWVRQAPGKGLKWVAVIWYDGSNKLYADSVKGRFTISRDNSKNTLYLQMNSLRAEDTAVYYCARDYYDNSRHHWGFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5465 - protein, 724 aa, Artificial Sequence
  Synthetic Polypeptide encoding a CAR with optional accessory module(s)
MALPVTALLLPLALLLHAARPEIQMTQSPSSMSASLGDTITITCQATQDIFKNLNWYQQKPGKPPSLLIYYATELAEGVPSRFSGSGSGSDYSLTISNLESEDFAAYYCLQFFEFPFTFGSGTKLEMKGGGGSGGGGSGGGGSQVQLQQSGAELVRPGTSVKVSCKASGYVFTNYWIEWIKQRPGQGLEWIGVMNPGSGETTYNEKFKGKATLTADKSSSTAYMQLSSLTSVDSAVYFCARDHDRDYYAMDYWGQGTSVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5466 - protein, 721 aa, Artificial Sequence
  Synthetic Polypeptide encoding a CAR with optional accessory module(s)
MALPVTALLLPLALLLHAARPDILLTQSPAILSVSPGERVSFSCRASQNIGTSIHWYQQRTNGSPRLLIKYASESVSGIPSRFSGSGSGTDFTLSINSVESEDIADYYCQHTNSWPTTFGGGTKLEIKRGGGGSGGGGSGGGGSQVQLQQSDAELVKPGASVKISCKASGYTFTDHAIHWVKQKPEQGLEWIGYFSPGNGDIKYNEKFKGKATLTADKSSSTAYMQLNSLTSEDSAVYFCKRSYGNYDYWGQGTTLTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5467 - protein, 726 aa, Artificial Sequence
  Synthetic Polypeptide encoding a CAR with optional accessory module(s)
MALPVTALLLPLALLLHAARPDIVMTQSPDSLAVSLGERATINCKSSQSLLNSGDQKNYLTWYQQKPGQPPKLLIYWASTRESGVPDRFSGSGSGTDFTLTISSLQAEDVAVYYCQNDYSYPLTFGQGTKVEIKGGGGSGGGGSGGGGSQVQLVQSGAEVKKTGSSVKVSCKASGYTFTDHAIHVWRQAPGQALEWMGHFSPGNTDIKYNDKFKGRVTLTVDRSMSTAYMELSSLRSEDTAMYYCKTSTFFFDYWGQGTMVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5468 - protein, 648 aa, Artificial Sequence
  Synthetic Polypeptide encoding a CAR with optional accessory module(s)
MELTELLLVVMLLLTARLTLSSPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLLGTQLPPQGRTTAHKDPNAIFLSFQHLLRGKVRFLMLVGGSTLCVRRAPPTTAVPSRTSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5469 - protein, 725 aa, Artificial Sequence
  Synthetic Polypeptide encoding a CAR with optional accessory module(s)
MALPVTALLLPLALLLHAARPDIQMTQSPSSLSASVGDRVTITCKASQDVSIAVAWYQQKPGKAPKVLIYSASYRYTGVPDRFSGSGSGTDFTFTISSLQPEDIAVYYCQQHYITPLTFGGGTKVEIKGGGGSGGGGSGGGGSQIQLVQSGHEVKKPGASVKVSCKASGYTFTNYGMNWVRQAPGQGLEWMGWINTKTGEPTYAEEFKGRFVFSLETSASTAYLQISSLKAEDTAMYFCGRGGYGSSYWYFDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5470 - protein, 727 aa, Artificial Sequence
  Synthetic Polypeptide encoding a CAR with optional accessory module(s)
MALPVTALLLPLALLLHAARPDIVMTQSPDSLAVSLGERATINCRASKSVSTSGYSYMHWYQQKPGQPPKLLIYLASNLESGVPDRFSGSGSGTDFTLTISSLQAEDVAVYYCQHSRELPYTFGQGTKLEIKGGGGSGGGGSGGGGSQVQLQESGPGLVKPSETLSLTCTVSGGSISSYGVHWIRQPPGKGLEWIGVIWTSGVTDYNSALMGRVTISVDTSKNQFSLKLSSVTAADTAVYYCARDGDYDRYTMDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5471 - protein, 706 aa, Artificial Sequence
  Synthetic Polypeptide encoding a CAR with optional accessory module(s)
MTALFLMSMLFGLACGQAMSFCIPTEYTMHIERRECAYCLTINTTICAGYCMTRDINGKLFLPKYALSQDVCTYRDFIYRTVEIPGCPLHVAPYFSYPVALSCKCGKCNTDYSDCIHEAIKTNYCTKPQKSYLVGFSVGGGGSGGGGSGGGGSAPDVQDCPECTLQENPFFSQPGAPILQCMGCCFSRAYPTPLRSKKTMLVQKNVTSESTCCVAKSYNRVTVMGGFKVENHTACHCSTCYYHKSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5472 - protein, 723 aa, Artificial Sequence
  Synthetic Polypeptide encoding a CAR with optional accessory module(s)
MALPVTALLLPLALLLHAARPQSVLTQPPSVSVSPGQTASITCSGDKLGDKYACWYQQKPGQSPVLVIYQDSKRPSGIPERFSGSNSGNTATLTISGTQAMDEADYYCQAWDSSTAVVFGGGTKLTVLGGGGSGGGGSGGGGSQVQLVQSGAEVKKPGQSLKISCKASGYSLTDNWIGWVRQKPGKGLEWMGIIYPGDSDTRYSPSFQGQVTISADKSINTAYLQWSSLKASDTAIYYCVGLDWNYNPLRYWGPGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5473 - protein, 721 aa, Artificial Sequence
  Synthetic Polypeptide encoding a CAR with optional accessory module(s)
MALPVTALLLPLALLLHAARPDIVMTQSQKFMSTSVGDRVSIICKASQNVGTFVAWYQQKPGQSPKLLVYSASNRYTGVPDRFTGSGSGTDFTLTINNMQSEDLADYFCRQYSSYPYTFGGGTKLEIKGGGGSGGGGSGGGGSEVQLQQSGPELVKPGASMKISCKASGYSFSAYTMNWVKQSHGKNLEWIGLINPYNGGTNYNQEFEGKATLTVNKSSNTAFMELLSLTSDDSAVYYCARRDWDYFDYWGQGTTLTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5474 - protein, 732 aa, Artificial Sequence
  Synthetic Polypeptide encoding a CAR with optional accessory module(s)
MALPVTALLLPLALLLHAARPAIQMTQSPSSLSASVGDRVTITCRASQSISNYLNWYQQKPGKAPKLLIYAASSLQSGVPSRFSGSGSGTDFTLTISSLQPEDFATYYCQQSYSSPSTTFGQGTKLEIKRGGGGSGGGGSGGGGSEVQLVESGGGLIQPGGSLRLSCAASGFTVSSNYMSWVRQAPGKGLEWVSVTYSGGSTSYADSVKGRFTISRDNSKNTLYLQMNSLRAEDTAVYYCARGGRYCSSISCYARSGCDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5475 - protein, 727 aa, Artificial Sequence
  Synthetic Polypeptide encoding a CAR with optional accessory module(s)
MALPVTALLLPLALLLHAARPDIQMTQSPSSLSASVGDRVTITCRASQSIGTSLHWYQQKPGKAPKLLIKFASRLQSGVPSRFSGSGSGTDFTLTISSLQPEDFATYYCQQSPGFPPTFGQGTKLEIKRGGGGSGGGGSGGGGSQVQLVESGGGLVKPGGSLRLSCAASGFSITTSGYYWTWIRQFPGKGLEWMGYIGYNSKTYYNPALKSRITISRDNAKNSLYLQMNSLRAEDTAVYYCARSLYGGYKDAFDSWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5476 - protein, 732 aa, Artificial Sequence
  Synthetic Polypeptide encoding a CAR with optional accessory module(s)
MALPVTALLLPLALLLHAARPDEIVLTQSPLSLPVTPGEPASISCRSSQSLLHSIGYNYLDWYLQKPGQSPQLLIYLGSNRASGVPDRFSGSGSGTDFTLKISRVEAEDVGVYYCMQALQTPLTFGGGTKVEIKRGGGGSGGGGSGGGGSEVQLVESGGGVVQPGRSLRLSCAASGFTFRSYGMHWVRQAPGKGLEWVAVISYDGSNKYYTDSVNGRFTISRDNSKNTLYLQMNSLRAEDTAVYYCARGGGYYETSGPDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5477 - protein, 730 aa, Artificial Sequence
  Synthetic Polypeptide encoding a CAR with optional accessory module(s)
MALPVTALLLPLALLLHAARPDDVVMTQSPLSLPVTPGEPASISCRSSQSLLHSIGYNYLHWFLQKPGQSPQLLIYLGSNRASGVPDRFSGSGSGTDFTLKISRVEAEDVGVYYCMQALQTPPTFGQGTRLEIKRGGGGSGGGGSGGGGSQLQLQESGPGLVKPSGTLSLTCAVSGGSISSSNWWSWVRQPPGKGLEWIGEIYHSGSTNYNPSLKSRVTISVDKSKNQFSLKLSSVTAADTAVYYCVGSPYGDYVLDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5478 - protein, 733 aa, Artificial Sequence
  Synthetic Polypeptide encoding a CAR with optional accessory module(s)
MALPVTALLLPLALLLHAARPDVVMTQSPLSLPVTPGEPASISCRSSQSLLHSNGHNYLDWYLQKPGQSPQLLIYLGSNRASGVPDRFSGSGSGTDFTLKISRVEAEDVGVYYCMQTLQTPLTFGPGTKVDIKRGGGGSGGGGSGGGGSEVQLVETGGGVVQPGRSLRLSCAASGFTFSSYGMHWVRQAPGKGLEWVAVISYDGSNKYYADSVKGRFTISRDNSKNTLYLQMNSLRAEDTAVYYCAKDRYGWGSSFGHFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5479 - protein, 728 aa, Artificial Sequence
  Synthetic Polypeptide encoding a CAR with optional accessory module(s)
MALPVTALLLPLALLLHAARPDEIVLTQSPGTLSLSLGERATLSCRASQSISSSFLAWYQQKPGQAPKLLIYAASTRATGIPDRFSGSGSGTDFTLTISRLEPEDFAVYYCQQYGRSLSFGGGTKVEVKGGGGSGGGGSGGGGSQVQLQQSGPGLVKPSQTLSLTCAISGDSVSGNSATWNWIRQSPSRGLEWLGRTYYRSKWNHDYAESVKSRITINPDTSKNQFSLQLNSVTPEDTAVYYCARGDSSSWYAFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5480 - protein, 728 aa, Artificial Sequence
  Synthetic Polypeptide encoding a CAR with optional accessory module(s)
MALPVTALLLPLALLLHAARPDQTVVTQPPSASGTPGQRVTISCSGSSSNIGSNYVYWYQQLPGTAPKLLIYRSNQRPSGVPDRFSGSKSGTSASLAISGPRSVDEADYYCAAWDDSLNGVVFGGGTKLTVLGGGGGSGGGGSGGGGSQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARRIPPYYGMDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5481 - protein, 728 aa, Artificial Sequence
  Synthetic Polypeptide encoding a CAR with optional accessory module(s)
MALPVTALLLPLALLLHAARPDQSVVTQPPSVSVAPGKTARITCGRNNIGSKSVHWYQQKPGQAPVLVVYDDSDRPSGIPERFSGSNSGNTATLTISRVEAGDEADYYCQVWDSSSDHVVFGGGTKLTVLGGGGGSGGGGSGGGGSEVQLVQSGGGVVRPGGSLRLSCAASGFTFDDYGMSWVRQAPGKGLEWVSGINWNGGSTGYADSVRGRFTISRDNAKNSLYLQMNSLRAEDTALYYCARERGYGYHDPHDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5482 - protein, 740 aa, Artificial Sequence
  Synthetic Polypeptide encoding a CAR with optional accessory module(s)
MALPVTALLLPLALLLHAARPEQKLISEEDLEFQAVVTQPPSASGTPGQRVTISCSGSSSNIGSNTVNWYQQVPGTAPKLLIYSNNQRPSGVPDRFSGSKSGTSASLAISGLQSEDEADYYCAAWDDSLNGWVFGGGTKLTVLGGGGSGGGGSGGGGSQMQLVQSGAEVKEPGESLRISCKGSGYSFTNFWISWVRQMPGKGLEWMGRVDPGYSYSTYSPSFQGHVTISADKSTSTAYLQWNSLKASDTAMYYCARVQYSGYYDWFDPWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5483 - protein, 734 aa, Artificial Sequence
  Synthetic Polypeptide encoding a CAR with optional accessory module(s)
MALPVTALLLPLALLLHAARPEQKLISEEDLEFDIQMTQSPSTLSASVGDRVTITCRASQNINKWLAWYQQRPGKAPQLLIYKASSLESGVPSRFSGSGSGTEYTLTISSLQPDDFATYYCQQYNSYATFGQGTKVEIKRGGGGSGGGGSGGGGSQVQLVQSGAEVKKPGESLKISCKGSGYNFSNKWIGWVRQLPGRGLEWIAIIYPGYSDITYSPSFQGRVTISADTSINTAYLHWHSLKASDTAMYYCVRHTALAGFDYWGLGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5484 - protein, 724 aa, Artificial Sequence
  Synthetic Polypeptide encoding a CAR with optional accessory module(s)
MALPVTALLLPLALLLHAARPEIVLTQSPGTLSLSPGERATLSCRASQSVSNTYLAWYHQRPGQAPRLLIYGASSRATGIPDRFSGSGSGTDFALTISSLEPEDFAVYYCQQYSNSWTFGQGTKVEIKRGGGGSGGGGSGGGGSQVQLVESGGGVVQPGRSLRLSCAASGFTFSSYDMHWVRQAPGKGLEWVAVISYDGTNEYYADSVKGRFTISRDTSKNTLYLQMNSLRAEDTAVYYCARERYFDWSFDYWGQGTLVSVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5485 - protein, 723 aa, Artificial Sequence
  Synthetic Polypeptide encoding a CAR with optional accessory module(s)
MALPVTALLLPLALLLHAARPELTQDPAVSVALGQTVRITCQGDSLRSNYANWYQQKPGQAPVLVIYGQNNRPSGIPDRFSGSSSGNTASLTITGAQAADEADYYCDSRVSTGNHVVFGGGTKLTVLGQGGGGSGGGGSGGGGSEVQLVQSGAEVKKPGASVKVSCKASGYTFTSYAMHWVRQAPGQRLEWMGWINAGNGNTKYSQKFQGRVTITRDTSASTAYMELSSLRSEDTAVYYCARDISYGSFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5486 - protein, 725 aa, Artificial Sequence
  Synthetic Polypeptide encoding a CAR with optional accessory module(s)
MALPVTALLLPLALLLHAARPDIVLTQTPATLSVTPGDSVSLSCRASQSISNNLHWYQQKSHESPRLLIKNASQSISGIPSKFSGSGSGTDFTLRINSVETEDFGMYFCQQSNSWPYTFGSGTKLEIKGGGGSGGGGSGGGGSQVKLQQSGPELVKPGASVKISCKASGYSFTGYYMHWVKQSHGNILDWIGYIYPYNGVSSYNQKFKGKATLTVDKSSSTAYMELRSLTSEDSAVYYCARERGLYQLRAMDYWGQGTSVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5487 - protein, 716 aa, Artificial Sequence
  Synthetic Polypeptide encoding a CAR with optional accessory module(s)
MALPVTALLLPLALLLHAARPDIVMTQTPAIMSASPGQKVTITCSASSSVNYMHWYQQKLGSSPKLWIYDTSKLAPGVPARFSGSGSGTSYSLTISSMEAEDAASYFCHQWSSYPYTFGSGTKLEIKGGGGSGGGGSGGGGSEVQLQESGPDLVKPSQSLSLTCTVTGYSITSGYGWHWIRQFPGNKLEWMGYIHYSGSTTYNPSLKSRISISRDTSKNQFFLQLNSVTTEDTATYYCARSLRYWGQGTTLTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5488 - protein, 719 aa, Artificial Sequence
  Synthetic Polypeptide encoding a CAR with optional accessory module(s)
MALPVTALLLPLALLLHAARPDIQMTQSPSSLSASVGDRVTITCSATSSISYMHWYQQKPGKAPKGWIYDTSKLAHGVPSRFSGSGSGTDFTLTISSLQPEDFATYYCHQRRSYPFTFGQGTKVEIKGGGGSGGGGSGGGGSEVQLVQSGAEVKKPGASVKVSCKASGYTFTNFWIHWVRQAPGQGLEWIGEIDPSDSYTNYNQKFKGRVTITRDTSTSTAYLELSSLRSEDTAVYYCAREITTVDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5489 - protein, 726 aa, Artificial Sequence
  Synthetic Polypeptide encoding a CAR with optional accessory module(s)
MALPVTALLLPLALLLHAARPDIQMTQSPSSLSASVGDRVTITCKASQGFNKYVAWYQQKPGKAPKLLIYYTSTLQPGVPSRFSGSGSGRDYTLTISSLQPEDFATYYCLQYGNLLYAFGQGTKVEIKRGGGGSGGGGSGGGGSEVQLVQSGAEVKKPGASVKVSCKASGYTFTSYWIGWVRQAPGQGLEWIGDIYPGGGYTNYNEKFKGRVTITRDTSTSTAYLELSSLRSEDTAVYYCARLDGSSYRGAMDSWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5490 - protein, 730 aa, Artificial Sequence
  Synthetic Polypeptide encoding a CAR with optional accessory module(s)
MALPVTALLLPLALLLHAARPDIQLTQSPSSLSASVGDRVTITCRASQSVDYDGDSYMNWYQQKPGKAPKLLIYAASYLESGVPSRFSGSGSGTDFTLTISSLQPEDFATYYCQQSHEDPYTFGQGTKVEIKRGGGGSGGGGSGGGGSEVQLVESGGGLVQPGGSLRLSCAVSGYSITSGYSWNWIRQAPGKGLEWVASITYDGSTNYNPSVKGRITISRDDSKNTFYLQMNSLRAEDTAVYYCARGSHYFGHWHFAVWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5491 - protein, 722 aa, Artificial Sequence
  Synthetic Polypeptide encoding a CAR with optional accessory module(s)
MALPVTALLLPLALLLHAARPDIQMTQSPSSLSASVGDRVTITCRASQDIRYYLNWYQQKPGKAPKLLIYVASSLQSGVPSRFSGSGSGTEFTLTVSSLQPEDFATYYCLQVYSTPRTFGQGTKVEIKGGGGSGGGGSGGGGSEVQLVESGGGLAKPGGSLRLSCAASGFRFTFNNYYMDWVRQAPGQGLEWVSRISSSGDPTWYADSVKGRFTISRENAKNTLFLQMNSLRAEDTAVYYCASLTTGSDSWGQGVLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5492 - protein, 723 aa, Artificial Sequence
  Synthetic Polypeptide encoding a CAR with optional accessory module(s)
MALPVTALLLPLALLLHAARPEIVMTQSPATLSVSPGERATLSCRASQSVSRNLAWYQQKPGQAPRLLIYGASTRATGIPARFSGSGSGTEFTLTIGSLQSEDFAVYYCQQYKTWPRTFGQGTNVEIKGGGGSGGGGSGGGGSQVQLQQWGAGLLKPSETLSLTCAVFGGSFSGYYWSWIRQPPGKGLEWIGEINHRGNTNDNPSLKSRVTISVDTSKNQFALKLSSVTAADTAVYYCARERGYTYGNFDHWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5493 - protein, 724 aa, Artificial Sequence
  Synthetic Polypeptide encoding a CAR with optional accessory module(s)
MALPVTALLLPLALLLHAARPEIVMTPSSATLSVSPGERATLSCRASQSVSRNLAWYQQKPGQAPRLLIYGASTRATGIPARFSGSGSGTEFTLTISSLQSEDFAVYYCHQYSNWMCSFGQGTKLEIKGGGGSGGGGSGGGGSEVQLLESGGGLVQPGGSLRLSCAASGFTFSRYAMNWVRQAPGKGLEWVSGISGSGGRTYYADSVKGRFTISRDNSKNTLYLQMNSLRAEDTAVYYCAKDRDFWSGPFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5494 - protein, 729 aa, Artificial Sequence
  Synthetic Polypeptide encoding a CAR with optional accessory module(s)
MALPVTALLLPLALLLHAARPDIQMTQSPSSLSASVGDRVTITCKASKNIRSYLAWYQQKPGKAPKLLIYSGSTLHSGVPSRFSGSGSGTDFTLTISSLQPEDFATYYCQQHHEYPLTFGQGTKVEIKRGGGGSGGGGSGGGGSQVQLQESGPGLVKPSETLSLTCTVSGYTITSGYDWSWIRQPPGKGLEWIGYINYGGSTNYKPSLGSRVTISVDTSKNQFSLKLSSVTAADTAVYYCARYNEYKSYIYDWYFDFWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5495 - protein, 722 aa, Artificial Sequence
  Synthetic Polypeptide encoding a CAR with optional accessory module(s)
MALPVTALLLPLALLLHAARPDVVMTQSPSSLSASVGDRVTITCMASEDIYIRLAWYQQKPGNAPKLLIYAATSLETGVPSRFSGSGSGTDFTLTISSLQPEDFATYYCQQYWSSPWTFGGGTKVEIKGGGGSGGGGSGGGGSQVQLQESGPGLVKPSQTLSLTCTVSGYSITSDYTWNWIRQPPGNGLEWIGYITYSGSTSYNPSLKSRVLISVDTSKNQVSLKLSSVTAADTAVYYCARLGRRYTMDYWGQGTTVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5496 - protein, 728 aa, Artificial Sequence
  Synthetic Polypeptide encoding a CAR with optional accessory module(s)
MALPVTALLLPLALLLHAARPEIVLTQSPATLSLSPGERATLSCSASSSVSYMYWYQQKPGQAPRLLIYRTSNLASGIPARFSGSGSGTDFTLTISSLEPEDFAVYYCQQYHSYPTTFGQGTKVEIKRTVGGGGSGGGGSGGGGSEVQLVESGGGLVQPGGSLRLSCAASGFSFNTYAMNWVRQAPGKGLEWVSHIRSKSNNFATYYADSVKDRFTISRDNAKNSLYLQMNSLRAEDTAVYYCARQGGDFPMDYWGQGTLVTVSSTRTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5497 - protein, 722 aa, Artificial Sequence
  Synthetic Polypeptide encoding a CAR with optional accessory module(s)
MALPVTALLLPLALLLHAARPDVVMTQSPSSLSASVGDRVTITCKASEDIYIRLAWYQQKPGKAPKLLIYAATSLETGVPSRFSGSGSGTDFTLTISSLQPEDFATYYCQQYWTTPWTFGGGTKVEIKGGGGSGGGGSGGGGSQVQLQESGPGLVKPSQTLSLTCTVSGYSITIDYTWNWIRQPPGKGLEWIGYITYSGSTDYNPSLKSRVLISVDTSKNQVSLKLSSVTAADTAVYYCARLGRRYALDYWGQGTTVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5498 - protein, 501 aa, Artificial Sequence
  Synthetic Polypeptide encoding a CAR with optional accessory module(s)
MALPVTALLLPLALLLHAARPDVVMTQSPSSLSASVGDRVTITCRASQDISKYLNWYQQKPGKAPKLLIYHTSRLHSGVPSRFSGSGSGTDFTLTISSLQPEDFATYYCQQGNTLPYTFGGGTKVEIKGGGGSGGGGSGGGGSQVQLQESGPGLVKPSQTLSLTCTVSGVSLPDYGVSWIRQPPGKGLEWIGVIWGSETTYYNSALKSRVLISVDTSKNQVSLKLSSVTAADTAVYYCARHYYYGGSYAMDYWGQGTTVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 5499 - protein, 508 aa, Artificial Sequence
  Synthetic Polypeptide encoding a CAR with optional accessory module(s)
MALPVTALLLPLALLLHAARPEIVLTQSPATLSLSPGERATLSCRASQSVSIYLAWYQQKPGQAPRLLIYDASNRATGIPARFSGSGSGTDFTLTISSLEPEDFAVYYCQQRSNWPPFTFGPGTKVDIKGGGGSGGGGSGGGGSQVQLVESGGGVVQPGRSLRLSCAASGFTFSSYGMHWVRQAPGKGLEWVAVIWDDGSNKYYVDSVKGRFTISRDNSKNTLYLQMNSLRAEDTAVYYCARDDYYGSGSFNSYYGTDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 5500 - protein, 493 aa, Artificial Sequence
  Synthetic Polypeptide encoding a CAR with optional accessory module(s)
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKGGGGSGGGGSGGGGSEVQLVQSGGGLVHPGGSLRLSCAGSGFTFSTYLMYWVRQAPGKTLEWVSAIGSGGDTYYADSVKGRFTISRDNAKNSLYLQMNSLRAEDMAVYYCARGLGYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 5501 - protein, 497 aa, Artificial Sequence
  Synthetic Polypeptide encoding a CAR with optional accessory module(s)
MALPVTALLLPLALLLHAARPQIVLTQSPAIMSASPGEKVTITCSASSSVSYMHWFQQKPGTSPKLWIYSTSNLASGVPARFSGSGSGTSYSLTISRMEAEDAATYYCQQRSSYPPTFGGGTKLEIKGGGGSGGGGSGGGGSQVQLQQSGAELMKPGASVKISCKATGYTFSSYWIEWVKQRPGHGLEWIGEILPGSGSTNYNEKFKGKATFTADTSSNTAYMQLSSLTSEDSAVYYCARYDYPWFAYWGQGTLVTVSATREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 5502 - protein, 505 aa, Artificial Sequence
  Synthetic Polypeptide encoding a CAR with optional accessory module(s)
MALPVTALLLPLALLLHAARPDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPFTFGSGTKLEIKGGGGSGGGGSGGGGSQVQLQQPGAELVRPGASVKLSCKASGYTFTSYWINWVKQRPGQGLEWIGNIYPSDSYTNYNQKFKDKATLTVDKSSSTAYMQLSSPTSEDSAVYYCTRSWRGNSFDYWGQGTTLTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 5503 - protein, 503 aa, Artificial Sequence
  Synthetic Polypeptide encoding a CAR with optional accessory module(s)
MALPVTALLLPLALLLHAARPDTQMTQSPSSVSASVGDRVTITCRTSQDISNYLNWYQQKPGKAPKLLIYNTSRLHSGVPSRFSGSGSGTDFTLTISSLQPEDFATYYCQQSNMFPYTFGQGTKLEIKGGGGSGGGGSGGGGSQVQLVQSGAEVKKPGASVKVSCKASGYTFNGYFMNWVRQAPGQGLERMGRINPNNGDSFYNQKFQGRVTMTRDTSTSTVYMELPSLRSEDTAVYYCAREGYYGGRGYALDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 5504 - protein, 727 aa, Artificial Sequence
  Synthetic Polypeptide encoding a CAR with optional accessory module(s)
MALPVTALLLPLALLLHAARPDIQLTQSPSFLSASVGDRVTITCRASQGISTDLNWYQQKPGKAPKLLIYAASNLESGVPSRFSGSGSGTEFTLTISSLQPEDFATYYCQQSYNWPYTFGGGTKVEIKRGGGGSGGGGSGGGGSEVQLVESGGGLVKPGGSLRLSCAASGFTFSNFEMNWVRQAPGKGLEWVSGISSNGRYINYADSVKGRFTISRDNAKNSLYLQMNSLRAEDTAVYYCARVVDFDQDYNGFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5505 - protein, 725 aa, Artificial Sequence
  Synthetic Polypeptide encoding a CAR with optional accessory module(s)
MALPVTALLLPLALLLHAARPDIQLTQSPSFLSASVGDRVTITCSLSLGISTWRDWFPPRLGRGLEPLTYAASTLQSGVPSRFSGSGSGTEFTLTISSLQPEDFATYYCQQLNSYPLTFGGGTKVEIKRGGGGSGGGGSGGGGSEVQLVESGGGLVKPGGSLRLSCAASGFTFSTYGMSWVRQAPGKGLEWVAYINNGSGYIYYADSVKGRFTISRDNAKNSLYLQMNSLRAEDTAVYYCARGQWWSGGDFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5506 - protein, 508 aa, Artificial Sequence
  Synthetic Polypeptide encoding a CAR with optional accessory module(s)
MALPVTALLLPLALLLHAARPDIVMTQSPSSLAMSVGQKVTMTCKSSQSLLNSSNQKNYLAWYQQKPGQSPKLLVYFASTRESGVPDRFIGSGSGTDFTLTISSVQAEDLADYFCHQHYSTPLTFGAGTKLELKGGGGSGGGGSGGGGSEVQLQQSGPDLVKPGASVKMSCKASGYTFTSYVMHWVKQKPGQGLEWIGYIYPYNDGTKYNEKFKGKATLTSDKSSSTAYMELSSLTSEDSAVYYCAREEYGNYVRYFDVWGAGTTVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 5507 - protein, 1145 aa, Artificial Sequence
  Synthetic Polypeptide encoding a CAR with optional accessory module(s)
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSRVEQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5508 - protein, 1145 aa, Artificial Sequence
  Synthetic Polypeptide encoding a CAR with optional accessory module(s)
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5509 - protein, 1145 aa, Artificial Sequence
  Synthetic Polypeptide encoding a CAR with optional accessory module(s)
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5510 - protein, 1146 aa, Artificial Sequence
  Synthetic Polypeptide encoding a CAR with optional accessory module(s)
MALPVTALLLPLALLLHAARPDEIVLTQSPATLSLSPGERATLSCSASSSVSYMHWYQQKPGQAPRLLIYDTSKLASGIPARFSGSGSGTDFTLTISSLEPEDVAVYYCFQGSVYPFTFGQGTKLEIKRGGGGSGGGGSGGGGSQVQLQESGPGLVKPSQTLSLTCTVSGGSISTSGMGVGWIRQHPGKGLEWIGHIWWDDDKRYNPALKSRVTISVDTSKNQFSLKLSSVTAADTAVYYCARMELWSYYFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5511 - protein, 1153 aa, Artificial Sequence
  Synthetic Polypeptide encoding a CAR with optional accessory module(s)
MALPVTALLLPLALLLHAARPDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5512 - protein, 1152 aa, Artificial Sequence
  Synthetic Polypeptide encoding a CAR with optional accessory module(s)
MALPVTALLLPLALLLHAARPDIVMTQAAPSIPVTPGESVSISCRSSKSLLNSNGNTYLYWFLQRPGQSPQLLIYRMSNLASGVPDRFSGSGSGTAFTLRISRVEAEDVGVYYCMQHLEYPFTFGAGTKLELKRGGGGSGGGGSGGGGSEVQLQQSGPELIKPGASVKMSCKASGYTFTSYVMHWVKQKPGQGLEWIGYINPYNDGTKYNEKFKGKATLTSDKSSSTAYMELSSLTSEDSAVYYCARGTYYYGSRVFDYWGQGTTLTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5513 - protein, 1150 aa, Artificial Sequence
  Synthetic Polypeptide encoding a CAR with optional accessory module(s)
MALPVTALLLPLALLLHAARPEIVLTQSPDFQSVTPKEKVTITCRASESVDTFGISFMNWFQQKPDQSPKLLIHAASNQGSGVPSRFSGSGSGTDFTLTINSLEAEDAATYYCQQSKEVPFTFGGGTKVEIKGGGGSGGGGSGGGGSEVQLVESGGGLVQPGGSLRLSCAASGFTFSSSWMNWVRQAPGKGLEWVGRIYPGDGDTNYNGKFKGRFTISRDDSKNSLYLQMNSLKTEDTAVYYCARSGFITTVLDFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5514 - protein, 1146 aa, Artificial Sequence
  Synthetic Polypeptide encoding a CAR with optional accessory module(s)
MALPVTALLLPLALLLHAARPAIQLTQSPSSLSASVGDRVTITCRASQGISSAQQKPGKAPKLLILAWYSSLESGVPSRFSGYDASGSGTDFTLTISSLQPEDFATYYCQQFNSYPYTFGQGTKLEIKGGGGSGGGGSGGGGSEVQLVQSGAEVKKPGESLKISCKGSGYSFSSSWIGWVRQMPGKGLEWMGIIYPDDSDTRYSPSFQGQVTISADKSIRTAYLQWSSLKASDTAMYYCARHVTMIWGVIIDFWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5515 - protein, 1170 aa, Artificial Sequence
  Synthetic Polypeptide encoding a CAR with optional accessory module(s)
MALPVTALLLPLALLLHAARPINIYNAEPANPSEKNSPEFDIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIKGGGGSGGGGSGGGGSEVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5516 - protein, 1152 aa, Artificial Sequence
  Synthetic Polypeptide encoding a CAR with optional accessory module(s)
MALPVTALLLPLALLLHAARPDILLTQSPATLSLSPGERATLSCRASQSVDYDGDSYLNWYQQKPGQPPKLLIYDASNLVSGIPPRFSGSGSGTDFTLTISRLEPEDFAVYHCQQSTEDPWTFGGGTKLEIKGGGGSGGGGSGGGGSQVQLVESGGGLVEPGGSLRLSCMSGYAFSSYWMNWVRQMPGKGLEWMGQIWPGDGDTNYNPSLKSRVTITADESTSTAYMELSSLKAEDTAVYFCARRETTTVGRYYYAMDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5517 - protein, 1149 aa, Artificial Sequence
  Synthetic Polypeptide encoding a CAR with optional accessory module(s)
MALPVTALLLPLALLLHAARPDILLTQSPATLSLSPGERATLSCRASQSVDNYGISFMNWYQQKPGQPPKLLIYAASNQGSGIPSRFSGSGSGTDFTLTISSLEPEDFAMYFCQQSNEVPRTFGGGTKLEIKGGGGSGGGGSGGGGSQVQLVESGGGLVEPGGSLRLSCMSGYAFSSSWMNWVRQMPGKGLEWMGRIYPGDGDTNYNGKFKERVTITADESTSTAYMELSSLKAEDTAVYFCARSEYWGNYWAMDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5518 - protein, 1148 aa, Artificial Sequence
  Synthetic Polypeptide encoding a CAR with optional accessory module(s)
MALPVTALLLPLALLLHAARPDILLTQSPATLSLSPGERATLSCKASQNVGTNVAWYQQKPGQPPKLLIYSATYRNSGIPARFSGSGSGTEFTLTITNVQSKDLADYFYFCQYNRYPYTSGGGTKLEIKRGGGGSGGGGSGGGGSQVQLVESGGGLVEPGGSLRLSCMSGYAFSSYWMNWVRQMPGKGLEWMGQIYPGDGDTNYNGKFKGRVTITADESTSTAYMELSSLKAEDTAVYFCARKTISSVVDFYFDNWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5519 - protein, 1161 aa, Artificial Sequence
  Synthetic Polypeptide encoding a CAR with optional accessory module(s)
MALPVTALLLPLALLLHAARPINIYNAEPANPSEKNSPEFQIVLTQSPATLSASPGEKATMTCSASSGVNYMHWYQQKPGTSPKRWIYDTDKTASGVPARFSGSGSGTSYSLTISSMEAEDAATYYCHQRGSYTFGGGTKLEIKGGGGSGGGGSGGGGSQVQLEQPGAEVVKPGASVKVSCKTSGYTFTSNWMHWVKQTPGKGLEWIGEIDPSDSYTNYNQKFDGKAKLTVDKSSSTAYMEVSDLTAEDSATYYCARGSNPYYYAMDYWGQGTSVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5520 - protein, 1147 aa, Artificial Sequence
  Synthetic Polypeptide encoding a CAR with optional accessory module(s)
MALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRGGGGSGGGGSGGGGSQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5521 - protein, 1155 aa, Artificial Sequence
  Synthetic Polypeptide encoding a CAR with optional accessory module(s)
MALPVTALLLPLALLLHAARPDDIQLTQSPSSLSASVGDRVTITCKASQSVDYDGDSYLNWYQQIPGKAPKLLIYDASNLVSGIPPRFSGSGSGTDYTFTISSLQPEDIATYHCQQSTEDPWTFGGGTKLQIKRGGGGSGGGGSGGGGSQVQLQQSGAEVKKPGSSVKVSCKASGYAFSSYWMNWVRQRPGQGLEWIGQIWPGDGDTNYNGKFKGRATITADESTNTAYMELSSLRSEDTAFYSCARRETTTVGRYYYAMDYWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5522 - protein, 1146 aa, Artificial Sequence
  Synthetic Polypeptide encoding a CAR with optional accessory module(s)
MALPVTALLLPLALLLHAARPQSVLTQPASVSGSPGQSITISCTGTSSDVGGYNYVSWYQQHPGKAPKLMIYDVNNRPSEVSNRFSGSKSGNTASLTISGLQAEDEADYYCSSYTTGSRAVFGGGTKLTVLGGGGGSGGGGSGGGGSEVQLVQSGAEVKKPGESLTISCKASGYSFPNYWITWVRQMSGGGLEWMGRIDPGDSYTTYNPSFQGHVTISIDKSTNTAYLHWNSLKASDTAMYYCARYYVSLVDIWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5523 - protein, 1152 aa, Artificial Sequence
  Synthetic Polypeptide encoding a CAR with optional accessory module(s)
MALPVTALLLPLALLLHAARPQSVVTQPPSVSAAPGQKVTISCSGSSSNIGNNYVSWYQQLPGTAPKLLIYDNNKRPSGIPDRFSGSKSGTSATLGITGLQTGDEADYYCGTWDGSLYTMLFGGGTKLTVLGGGGSGGGGSGGGGSEVQLVESGGGLVKPGGSLRLSCAASGFTFSNAWMSWVRQAPGKGLEWVGFIRSKAYGGTTEYAASVKGRFTISRDDSKSIAYLQMNNLKTEDTAVYYCARDGLYSSSWYDSDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5524 - protein, 1157 aa, Artificial Sequence
  Synthetic Polypeptide encoding a CAR with optional accessory module(s)
MALPVTALLLPLALLLHAARPQSVLTQPPSVSGAPGQRVTISCTGSSSNIGAGYDVHWYQQLPGTAPKLLIFGNSNRPSGVPDRFSGFKSGTSASLAITGLQAEDEADYFCQSYDSSLSGSGVFGTGTKVTVLGGGGGSGGGGSGGGGSQMQLVQSGGGLVQPGRSLRLSCAASGFTFDDYAMHWVRQAPGKGLEWVSGISWNSGSIGYADSVKGRFTISRDNAKNSLYLQMNSLRAEDTALYYCAKDIHSGSYYGLLYYAMDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5525 - protein, 1144 aa, Artificial Sequence
  Synthetic Polypeptide encoding a CAR with optional accessory module(s)
MALPVTALLLPLALLLHAARPDYIHVTQSPSSLSVSIGDRVTINCQTSQGVGSDLHWYQHKPGRAPKLLIHHASSVEDGVPSRFSGTGFHTSFNLTINDLQADDIGTYYCQVLQSFGRGSRLDTKGGGGSGGGGSGGGGSRAHLVQSGTAMKKPGASVRVSCQTSGYTFTAHILFWFRQAPGRGLEWVGWIKPQYGAVNFGGGFRDRVTLTRDVYREIAYMDIRGLKPDDTAVYYCARDRSYGDSSWALDAWGQGTTVVVSATREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5526 - protein, 1154 aa, Artificial Sequence
  Synthetic Polypeptide encoding a CAR with optional accessory module(s)
MALPVTALLLPLALLLHAARPDVQMIQTPDSLAVSLGQRATISCRASESVDNYGISFMHWYQQKPGQSPKLLIYRASNLESGIPARFSGSGSRTDFTLTINPVETDDVATYYCQQNNKDPPTFGGGTKLEIKGGGGSGGGGSGGGGSGGGGSQVQLQQSGAELVKPGASVKISCKASGYAFSSYWMNWVKQRPGKGLEWIGQIYPGDGDTTYNGKFKGKATLTADKSSSTVYMQLNSLTSEDSAVYFCVRYYYGSSGYFDYWGQGTTLTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5527 - protein, 1145 aa, Artificial Sequence
  Synthetic Polypeptide encoding a CAR with optional accessory module(s)
MALPVTALLLPLALLLHAARPDVQMIQTPSSLSASLGDRVTISCRASQDIGNYLNWYQQKPDGTVKLLIYYTSRLHSGVPSRFSGSGSGTEYSLTISNLEQEDIATYFCQQGSALPPTFGGGTKLEINGGGGSGGGGSGGGGSALQLQQSGAELVRPGASVTLSCKASGYTFTDYEMHWVKQTPVHGLEWIGAIDPETGGTAYNQKFEGKAILTADKSSSTAYMELRSLTSEDSPVYYCARRRYYGSSSFDYWGQGTTLTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5528 - protein, 1152 aa, Artificial Sequence
  Synthetic Polypeptide encoding a CAR with optional accessory module(s)
MRLPAQLLGLLMLWVSGSSGDVVMTQSPLSLPVTPGAPASISCRSSQSIVHSNGNTYLEWYLQKPGQSPKLLIYKVSNRFSGVPDRFSGSGSGTDFTLRISRVEAEDVGIYYCFQGSHVPPTFGPGTKLEIKGGGGSGGGGSGGGGSEVQLVESGGGLVQPGGSLRLSCSASGFTFSSFGMHWVRQAPGKGLEWVAYISSGSSTIYYGDTVKGRFTISRDNAKNSLFLQMSSLRAEDTAVYYCAREGGYYYGRSYYTMDYWGQGTTVTVSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5529 - protein, 1177 aa, Artificial Sequence
  Synthetic Polypeptide encoding a CAR with optional accessory module(s)
MALPVTALLLPLALLLHAARPARKRTQPTFGFTVNWKFSESTTVFTGQCFIDRNGKEVLKTMWLLRSSVNDIGDDWKATRVGINIFTRLRTQKEGGSGGSARKCSLTGKWTNDLGSNMTIGAVNSRGEFTGTYITAVTATSNEIKESPLHGTQNTINKSGGSTTVFTGQCFIDRNGKEVLKTMWLLRSSVNDIGDDWKATRVGINIFTRLRTQKEGGSGGSARKCSLTGKWTNDLGSNMTIGAVNSRGEFTGTYITAVTATSNEIKESPLHGTQNTINKRTQPTFGFTVNWKFSETREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5530 - protein, 1149 aa, Artificial Sequence
  Synthetic Polypeptide encoding a CAR with optional accessory module(s)
MALPVTALLLPLALLLHAARPDIVLTQSPASLAVSLGQRATISCRASKSVSTSGYSYLHWYQQKPGQPPKLLIYLASNLESGVPARFSGSGSGTDFTLNIHPVEEEDAATYYCQHSRELPFTFGSGTKLEIKGGGGSGGGGSGGGGSQVQLVESGGGLVQPGGSLKLSCAASGFDFSRYWMSWVRQAPGKGLEWIGEINPTSSTINFTPSLKDKVFISRDNAKNTLYLQMSKVRSEDTALYYCARGNYYRYGDAMDYWGQGTSVTVSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5531 - protein, 1147 aa, Artificial Sequence
  Synthetic Polypeptide encoding a CAR with optional accessory module(s)
MALPVTALLLPLALLLHAARPDIQMTQSPSSLSASVGDRVTITCSASQDISNYLNWYQQKPGKAPKLLIYYTSNLHSGVPSRFSGSGSGTDFTLTISSLQPEDFATYYCQQYRKLPWTFGQGTKLEIKRGGGGSGGGGSGGGGSQVQLVQSGAEVKKPGSSVKVSCKASGGTFSNYWMHWVRQAPGQGLEWMGATYRGHSDTYYNQKFKGRVTITADKSTSTAYMELSSLRSEDTAVYYCARGAIYDGYDVLDNWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5532 - protein, 1147 aa, Artificial Sequence
  Synthetic Polypeptide encoding a CAR with optional accessory module(s)
MALPVTALLLPLALLLHAARPDIVLTQSPATLSLSPGDRATISCRASESVTILGSHLIYWYQQKPGQPPRLLIQLASNVQTGVPARFSGSGSRTDFTLTISSVEPEDFAVYYCLQSRTIPRTFGQGTKLEIKRGGGGSGGGGSGGGGSQVQLVQSGPEVKKPGESVKISCKASGYTFRHYSMNWVKQAPGQGLKWMGRINTESGVPIYADDFKGRFSFTVDTSASTAYLEISSLTSEDTAVYFCSNDYLYSLDFWGQGTTLTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5533 - protein, 1148 aa, Artificial Sequence
  Synthetic Polypeptide encoding a CAR with optional accessory module(s)
MALPVTALLLPLALLLHAARPQSVLTQPPSVSGAPGQRVTISCTGSSSNIGAGFDVHWYQQLPGTAPKLLIYGNSNRPSGVPDRFSGSKSGTSASLAITGLQAEDEADYYCQSYDSSLSGYVFGTGTKVTVLGGGGGSGGGGSGGGGSQVQLVQSGAEVKKPGASVKVSCKASGYTFTDYYMHWVRQAPGQRLEWMGWINPNSGGTNYAQKFQDRITVTRDTSSNTGYMELTRLRSDDTAVYYCARSPYSGVLDKWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5534 - protein, 1146 aa, Artificial Sequence
  Synthetic Polypeptide encoding a CAR with optional accessory module(s)
MALPVTALLLPLALLLHAARPQAVLTQPPSASGTPGQRVTISCSGSSSNIGSYTVSWYQQLPGTAPKFLIYSNNQRPSGVPDRFSGSKSGTSASLAISGLQSEDEADYYCAAWDDSLNGYVFGTGTKVTVLGGGGGSGGGGSGGGGSEVQLVQSGAEVKKPGESLKISCKGSGYDFTTYWIGWVRQMPGKGLEWMGIIYPGDSDTRYSPSVRGRVTISADKSINTAYLQWSSLEASDTAMYYCARMWTFSQDGWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5535 - protein, 1157 aa, Artificial Sequence
  Synthetic Polypeptide encoding a CAR with optional accessory module(s)
MALPVTALLLPLALLLHAARPLPVLTQPPSASGTPGQRVTISCSGRSSNIGSNSVNWYRQLPGAAPKLLIYSNNQRPPGVPVRFSGSKSGTSASLAISGLQSEDEATYYCATWDDNLNVHYVFGTGTKVTVLGSRGGGGSGGGGSGGGGSLEMAQVQLVQSGAEVKKPGSSVKVSCKASGGTFSSYAISWVRQAPGQGLEWMGRIIPILGIANYAQKFQGRVTITADKSTSTAYMELSSLRSEDTAVYYCARGGYYSHDMWSEDWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5536 - protein, 1146 aa, Artificial Sequence
  Synthetic Polypeptide encoding a CAR with optional accessory module(s)
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRIFPRTFGQGTKLEIKGGGGSGGGGSGGGGSQVQLVQSGSELKKPGESVKISCKASGYTFTDYSINWVKQAPGQGLKWMGWINTETREPAYAYDFRGRFVFSLDTSASTAYLQISSLKAEDTAVYFCALDYSYAMDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5537 - protein, 1147 aa, Artificial Sequence
  Synthetic Polypeptide encoding a CAR with optional accessory module(s)
MALPVTALLLPLALLLHAARPDIVLTQSPATLSLSPGDRATLSCRASESVTILGSHLIYWYQQKPGQAPRLLIQLASNVQTGIPARFSGSGSRTDFTLTISSLEPEDFAVYYCLQSRTIPRTFGQGTKLEIKRGGGGSGGGGSGGGGSQVQLVQSGSELKKPGESVKISCKASGYTFTHYSMNWVRQAPGQGLEWMGRINTETGEPLYADDFKGRFVFSLDTSASTAYLQISSLKAEDTAVYYCSNDYLYSLDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5538 - protein, 1148 aa, Artificial Sequence
  Synthetic Polypeptide encoding a CAR with optional accessory module(s)
MALPVTALLLPLALLLHAARPDIVMTQSPDSLAVSLGERATINCKSSQSILYSSNQKNYLAWYQQKPGQSPKLLIYWASTRESGVPDRFSGSGSGTDFTLTISSLQAEDVAVYYCHQYISSYTFGQGTKLEIKGGGGSGGGGSGGGGSQVQLVQSGAEVKKPGASVKVSCKASGYTFASQWMHWMRQAPGQGLEWIGWINPGNVNTKYNEKFKGRATLTVDTSTNTAYMELSSLRSEDTAVYYCARSTWYRPLDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5539 - protein, 1272 aa, Artificial Sequence
  Synthetic Polypeptide encoding a CAR with optional accessory module(s)
MVRGVPFRHLLLVLQLALLPAATQGKKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASGGGGSGGGGSGGGGSIYQELTQLKAAVERLCHPCPWEWTFFQGNCYFMSNSQRNWHDSITACKEVGAQLVVIKSAEEQNFLQLQSSRSNRFTWMGLSDLNQEGTWQWVDGSPLLPSFKQYWNRGEPNNVGEEDCAEFSGNGWNDDKCNLAKFWICKKSAASCSRDEEQFLSPAPATPNPPPATREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5540 - protein, 1148 aa, Artificial Sequence
  Synthetic Polypeptide encoding a CAR with optional accessory module(s)
MALPVTALLLPLALLLHAARPDHIVLTQSPSSLSASLGDRVTISCRASQDISTYLNWYQQKPDGTVKLLIFYTSRLHAGVPSRFSGSGSGTHHSLTISNLEQEDIATYFCQQGNSLPFTFGSGTKLEIKRGGGGSGGGGSGGGGSQVQLKESGPELEKPGASVKISCKASGYSFTAYSMNWVKQNNGMSLEWIGSIDPYYGDTKYAQKFKGKATLTVDKASSTAYLQLKSLTSEDSAVYYCARRMITTGDWYFDVWGAGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5541 - protein, 1148 aa, Artificial Sequence; identical to SEQ ID NO: 5540
  Synthetic Polypeptide encoding a CAR with optional accessory module(s)

SEQ ID NO: 5542 - protein, 1095 aa, Artificial Sequence
  Synthetic Polypeptide encoding a CAR with optional accessory module(s)
MALPVTALLLPLALLLHAARPGMRTEDLPKAVVFLEPQWYRVLEKDSVTLKCQGAYSPEDNSTQWFHNESLISSQASSYFIDAATVDDSGEYRCQTNLSTLSDPVQLEVHIGWLLLQAPRWVFKEEDPIHLRCHSWKNTALHKVTYLQNGKGRKYFHHNSDFYIPKATLKDSGSYFCRGLVGSKNVSSETVNITITQGLAVSTISSFFPPGYQTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5543 - protein, 1095 aa, Artificial Sequence; identical to SEQ ID NO: 5542
  Synthetic Polypeptide encoding a CAR with optional accessory module(s)

SEQ ID NO: 5544 - protein, 1148 aa, Artificial Sequence
  Synthetic Polypeptide encoding a CAR with optional accessory module(s)
MALPVTALLLPLALLLHAARPDEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKGGGGSGGGGSGGGGSEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5545 - protein, 1150 aa, Artificial Sequence
  Synthetic Polypeptide encoding a CAR with optional accessory module(s)
MALPVTALLLPLALLLHAARPDIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKRGGGGSGGGGSGGGGSQVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5546 - protein, 1147 aa, Artificial Sequence
  Synthetic Polypeptide encoding a CAR with optional accessory module(s)
MALPVTALLLPLALLLHAARPDIVLTQSPAIITASPGEKVTMTCRASSSVNYMDWYQKKPGSSPKPWIYATSNLASGVPSRFSGSGSGTTYSMTISSLEAEDAATYYCQQWSFNPPTFGGGTKLEIKRGGGGSGGGGSGGGGSEVQLQQSGAELKKPGASVKVSCKASGYTFTSYNMHWVKQTPGQGLEWIGAIYPGNGDTSYNQKFKGKTTLTADKSSSTAYMELSSLRSEDTAVYYCARSNYYGSSYWFFDVWGTGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5547 - protein, 1150 aa, Artificial Sequence
  Synthetic Polypeptide encoding a CAR with optional accessory module(s)
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSDWPLTFGGGTKVEIKGGGGSGGGGSGGGGSEVQLVQSGGGLVHPGGSLRLSCTGSGFTFSYHAMHWVRQAPGKGLEWVSIIGTGGVTYYADSVKGRFTISRDNVKNSLYLQMNSLRAEDMAVYYCARDYYGAGSFYDGLYGMDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5548 - protein, 1148 aa, Artificial Sequence
  Synthetic Polypeptide encoding a CAR with optional accessory module(s)
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGGGTKVEIKGGGGSGGGGSGGGGSAVQLVESGGGLVQPGRSLRLSCAASGFTFGDYTMHWVRQAPGKGLEWVSGISWNSGSIGYADSVKGRFTISRDNAKNSLYLQMNSLRAEDTALYYCTKDNQYGSGSTYGLGVWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5549 - protein, 1147 aa, Artificial Sequence
  Synthetic Polypeptide encoding a CAR with optional accessory module(s)
MALPVTALLLPLALLLHAARPDIQMTQSPSSLSASVGDRVTITCRASSSVSYMHWYQQKPGKAPKPLIYAPSNLASGVPSRFSGSGSGTDFTLTISSLQPEDFATYYCQQWSFNPPTFGQGTKVEIKRGGGGSGGGGSGGGGSEVQLVESGGGLVQPGGSLRLSCAASGYTFTSYNMHWVRQAPGKGLEWVGAIYPGNGDTSYNQKFKGRFTISVDKSKNTLYLQMNSLRAEDTAVYYCARVVYYSNSYWYFDVWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5550 - protein, 1145 aa, Artificial Sequence
  Synthetic Polypeptide encoding a CAR with optional accessory module(s)
MALPVTALLLPLALLLHAARPDIQLTQSPSSLSASVGDRVTMTCRASSSVSYIHWFQQKPGKAPKPWIYATSNLASGVPVRFSGSGSGTDYTFTISSLQPEDIATYYCQQWTSNPPTFGGGTKLEIKGGGGSGGGGSGGGGSQVQLQQSGAEVKKPGSSVKVSCKASGYTFTSYNMHWVKQAPGQGLEWIGAIYPGNGDTSYNQKFKGKATLTADESTNTAYMELSSLRSEDTAFYYCARSTYYGGDWYFDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5551 - protein, 1157 aa, Artificial Sequence
  Synthetic Polypeptide encoding a CAR with optional accessory module(s)
MALPVTALLLPLALLLHAARPSTVMTQSPDSLAVSLGERATINCKSSQSNSNDVAWYQQKPGQSPKVLIYFASNRYSGVPDRFSGSGYGTDFTLTISSLQAEDVAVYFCQQDYSSPLTFGAGTKLELKRADAGGGGSGGGGSGGGGSQIQLVQSGSELKKPGASVKVSCKASGYTFTNFGVNWVRQAPGKGLEWMGWINTYTGEPSYAQGFTGRFVFSLDASVSTAYLQISSLKAEDTATYFCTRRTNYYGTSYYYAMDYWGQGTTVTVSSAKTTTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5552 - protein, 1149 aa, Artificial Sequence
  Synthetic Polypeptide encoding a CAR with optional accessory module(s)
MALPVTALLLPLALLLHAARPQIVLSQSPAILSASPGEKVTMTCRASSSVSYMHWYQQKPGSSPKPWIYATSNLASGVPARFSGSGSGTSYSFTISRVEAEDAATYYCQQWTFNPPTFGGGTRLEIKRTVAAGGGGSGGGGSGGGGSQAYLQQSGAELVRPGASVKMSCKASGYTFTSYNMHWVKQTPRQGLEWIGGIYPGNGDTSYNQKFKGKATLTVGKSSSTAYMQLSSLTSEDSAVYFCARYDYNYAMDYWGQGTSVTVSSASTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5553 - protein, 1147 aa, Artificial Sequence; identical to SEQ ID NO: 5549
  Synthetic Polypeptide encoding a CAR with optional accessory module(s)

SEQ ID NO: 5554 - protein, 1146 aa, Artificial Sequence
  Synthetic Polypeptide encoding a CAR with optional accessory module(s)
MALPVTALLLPLALLLHAARPEIVLTQSPSSLSASVGDRVTITCRASSSLSFMHWYQQKPGKAPKPWIYATSNLASGVPSRFSGSGSGTDYTLTISSLQPEDFATYFCHQWSSNPLTFGGGTKVEIKGGGGSGGGGSGGGGSQVQLVQSGAEVKKPGASVKVSCKASGYTFTSYNMHWVRQAPGQRLEWIGAIYPGNGDTSYNQKFKGRVTVTRDTSANTAYMELSSLKSEDTAVYYCARSHYGSNYVDYFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5555 - protein, 1148 aa, Artificial Sequence
  Synthetic Polypeptide encoding a CAR with optional accessory module(s)
MALPVTALLLPLALLLHAARPDEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKGGGGSGGGGSGGGGSEVQLVESGGGLVQPDRSLRLSCAASGFTFHDYAMHWVRQAPGKGLEWVSTISWNSGTIGYADSVKGRFTISRDNAKNSLYLQMNSLRAEDTALYYCAKDIQYGNYYYGMDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5556 - protein, 1146 aa, Artificial Sequence
  Synthetic Polypeptide encoding a CAR with optional accessory module(s)
MALPVTALLLPLALLLHAARPEIVLTQSPGTLSLSPGERATLSCRASSSVPYIHWYQQKPGQAPRLLIYATSALASGIPDRFSGSGSGTDFTLTISRLEPEDFAVYYCQQWLSNPPTFGQGTKLELKRGGGGSGGGGSGGGGSEVQLVQSGAEVKKPGESLKLSCKGSGRTFTSYNMHWVRQMPGKGLEWMGAIYPLTGDTSYNQKSKLQVTISADKSISTAYLQWSSLKASDTAMYYCARSTYVGGDWQFDVWGKGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5557 - protein, 1151 aa, Artificial Sequence
  Synthetic Polypeptide encoding a CAR with optional accessory module(s)
MALPVTALLLPLALLLHAARPDIQMTQSPSSLSASVGDRVTITCRSSQSIVHSVGNTFLEWYQQKPGKAPKLLIYKVSNRFSGVPSRFSGSGSGTDFTLTISSLQPEDFATYYCFQGSQFPYTFGQGTKVEIKRGGGGSGGGGSGGGGSEVQLVESGGGLVQPGGSLRLSCAASGYEFSRSWMNWVRQAPGKGLEWVGRIYPGDGDTNYSGKFKGRFTISADTSKNTAYLQMNSLRAEDTAVYYCARDGSSWDWYFDVWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5558 - protein, 1143 aa, Artificial Sequence
  Synthetic Polypeptide encoding a CAR with optional accessory module(s)
MALPVTALLLPLALLLHAARPDIVMTQSPSSLSASVGDRVTITCKASQSVTNDVAWYQQKPGKAPKLLIYYASNRYTGVPSRFSGSGSGTDFTLTISSLQPEDFATYYCQQDYRSPWTFGGGTKVEIKRGGGGSGGGGSGGGGSQVQLEESGGGVVRPGRSLRLSCAASGFTFSDYGVNWIRQAPGKGLEWVTIIWGDGRTDYNSALKSRFTVSRNNSNNTLSLQMNSLTTEDTAVYYCVRAPGNRAMEYWGQGVLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5559 - protein, 1149 aa, Artificial Sequence
  Synthetic Polypeptide encoding a CAR with optional accessory module(s)
MALPVTALLLPLALLLHAARPDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQIFGQGTKLEIKGGGGSGGGGSGGGGSQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5560 - protein, 1149 aa, Artificial Sequence
  Synthetic Polypeptide encoding a CAR with optional accessory module(s)
MALPVTALLLPLALLLHAARPQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSGGGGSGGGGSGGGGSDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQIFGQGTKLEIKTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5561 - protein, 1142 aa, Artificial Sequence
  Synthetic Polypeptide encoding a CAR with optional accessory module(s)
MALPVTALLLPLALLLHAARPDIQMTQSPATIENTSLSASVGDRVTITCRASQGISSWLTWYQQKPEKAPKSLIYAASSLQSGVPSRFSGSGSGTDFTLTISSLQPEDFATYYCQQYDSYPITFGQGTRLEIKGGGGSGGGGSGGGGSQVQLQQWGAGLLKPSETLSLTCAVYGGSFSAYYWSWIRQPPGKGLEWIGDINHGGGTNYNPSLKSRVTISVDTSKNQFSLKLNSVTAADTAVYYCASLTAYWGQGSLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5562 - protein, 1147 aa, Artificial Sequence
  Synthetic Polypeptide encoding a CAR with optional accessory module(s)
MALPVTALLLPLALLLHAARPDEIVLTQSPDSLAVSLGERATINCKASQSVDFDGDSYLNWYQQKPGQPPKVLIYAASTLQSGVPSRFSGSGSGTDFTLTINSLEAEDAATYYCQQSNEDPWTFGGGTKVEIKGGGGSGGGGSGGGGSQVQLVQSGAEVKKPGASVKVSCKVSGYTFTDYYITWVRQAPGQALEWMGWIYPGSGNTKYSQKFQGRFVFSVDTSASTAYLQLSSLKAEDTAVYYCANYGNYWFAYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5563 - protein, 1144 aa, Artificial Sequence
  Synthetic Polypeptide encoding a CAR with optional accessory module(s)
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKGGGGSGGGGSGGGGSEVQLVQSGGGLVHPGGSLRLSCAGSGFAFSSSTMHWIRQAPGKGLEWISLIGSGGGIYYGDSVKGRFTISRDNAKNSLYLQMNSLRAEDMAVYYCVRGYFDWVDYFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5564 - protein, 1154 aa, Artificial Sequence
  Synthetic Polypeptide encoding a CAR with optional accessory module(s)
MALPVTALLLPLALLLHAARPDDIVMTQSPDSLTVSLGERTTINCKSSQSVLDSSKNKNSLAWYQQKPGQPPKLLLSWASTRESGIPDRFSGSGSGTDFTLTIDSLQPEDSATYYCQQSAHFPITFGQGTRLEIKGGGGSGGGGSGGGGSQVQLVQSGAEVKKPGASVKVSCKASGYTFTNYGMNWVKQAPGQGLKWMGWINTYTGEPTYADDFKGRVTMTSDTSTSTAYLELHNLRSDDTAVYYCARWSWSDGYYVYFDYWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5565 - protein, 1150 aa, Artificial Sequence
  Synthetic Polypeptide encoding a CAR with optional accessory module(s)
MALPVTALLLPLALLLHAARPDEIVLTQSPGSLAVSPGERVTMSCKSSQSVFFSSSQKNYLAWYQQIPGQSPRLLIYWASTRESGVPDRFTGSGSGTDFTLTISSVQPEDLAIYYCHQYLSSRTFGQGTKLEIKRGGGGSGGGGSGGGGSQVQLQQPGAEVVKPGASVKMSCKASGYTFTSYYIHWIKQTPGQGLEWVGVIYPGNDDISYNQKFQGKATLTADKSSTTAYMQLSSLTSEDSAVYYCAREVRLRYFDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5566 - protein, 1176 aa, Artificial Sequence
  Synthetic Polypeptide encoding a CAR with optional accessory module(s)
MALPVTALLLPLALLLHAARPYINIYNAEPANPSEKNSPTQYAYGSGEFDIQLTQSPSSLSASVGDRVTITCRASQGISSVLAWYQQKPGKAPKLLIYDASSLESGVPSRFSGSGSGTDFTLTISSLQPEDFATYYCQQFNSSITFGQGTKLEIKRTVAAGGGGSGGGGSGGGGSQVQLVQSGAEVKKPGSSVKVSCKASGGTFSDYAISWVRQAPGQGLEWMGRIIPILGVANYAQKFQGRVTITADKSTRTAYMELSSLRSEDTAVYYCARNWADAFDIWGQGTMVTVSSASTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5567 - protein, 1175 aa, Artificial Sequence
  Synthetic Polypeptide encoding a CAR with optional accessory module(s)
MALPVTALLLPLALLLHAARPYINIYNAEPANPSEKNSPTQYAYGSGEFDIVMTQSPSSLSASLGGKVTITCKASQDINKYIAWYQHKPGKGPRLLIHYTSTLQPGIPSRFSGSGSGRDYSFSISNLEPEDIATYYCLQYDNLLTFGAGTKLELKRGGGGSGGGGSGGGGSEVKLQQSGPELVKPGTSVKVSCKASGYSFTDYNMYWVKQSHGKSLEWIGYIDPYKGGTIYNQKFKGKATLTVDKSSSTAFMHLNSLTSEDSAVYYCAREMITAYYFDYWGQGSSVTVSSLERTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5568 - protein, 1191 aa, Artificial Sequence
  Synthetic Polypeptide encoding a CAR with optional accessory module(s)
MALPVTALLLPLALLLHAARPDIQMTQSPSSLSASVGDRVTINCKASQDINSYLSWFQQKPGKAPKTLIYRANRLVDGVPSRFSGSGSGQDYTLTISSLQPEDFATYYCLQYDEFPLTFGGGTKVEIKGGGGSGGGGSGGGGSQVQLVQSGAEVKKPGASVKVSCKASGYTFTNYDINWVRQAPGQGLEWIGWIYPGDGSTKYNEKFKAKATLTADTSTSTAYMELRSLRSDDTAVYYCASGYEDAMDYWGQGTTVTVSSAKPTTTPAPRPPTPAPTIASQPLSLRPEACRPAAGGAVHTRGLDFACDITREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5569 - protein, 1147 aa, Artificial Sequence
  Synthetic Polypeptide encoding a CAR with optional accessory module(s)
MALPVTALLLPLALLLHAARPEIVLTQSPLSLPVTPGEPASISCRSSQSLLHSNGYNYLDWYLQKPGQSPQLLIYLGVNSVSGVPDRFSGSGSGTDFTLKISRVEAEDVGVYYCMQALQTPWTFGQGTKVEIKGGGGSGGGGSGGGGSQVQLVQSGAEVKKPGSSVKVSCKASGGIFSNHAISWVRQAPGQGLEWMGGIIPIFGTANYAQKFQGRVTITADESTSTAFMELSSLRSEDTAVYYCAREWADVFDIWGQGTMVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5570 - protein, 1146 aa, Artificial Sequence
  Synthetic Polypeptide encoding a CAR with optional accessory module(s)
MALPVTALLLPLALLLHAARPDIQMTQSPASLTVSLGQRATISCRASESVDSYGNSYLHWYQQKPGQPPQLLIYLASNLESGVPARFSGSGSRTDFTLTIDPVEADDAATYYCQQNNEDPWTFGGGTKVEIKGGGGSGGGGSGGGGSEVQLQQSGAELVKPGASVKMSCKAFGYTFTTFPIEWMKQSHGKSLEWIGNFHPYNDQTKYNEEFKGRAKLTIDRSSSTVYLELGRLTSDDSAVYYCARGYYYAFDFWGQGTTLTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5571 - protein, 1143 aa, Artificial Sequence
  Synthetic Polypeptide encoding a CAR with optional accessory module(s)
MALPVTALLLPLALLLHAARPDIQMTQSPSSLSASVGDRVTITCRASQGIRNDLGWYQQKPGKAPKRLIYAASSLQSGVPSRFSGSGSGTEFTLTISSLQPEDFATYYCLQHNSYPWTFGQGTKLEIKGGGGSGGGGSGGGGSEVQLVESGGALIQPGGSLRLSCVASGFTISGNYMSWVRQAPGKGLEWVSLIYSGDSTYYADSVKGRFTISRDISKNTVYLQMNSLRVEDTAVYYCVRDGYYVSDMVVWGKGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5572 - protein, 1153 aa, Artificial Sequence
  Synthetic Polypeptide encoding a CAR with optional accessory module(s)
MALPVTALLLPLALLLHAARPDVLLTQSPLSLPVTLGQPASISCRSSQTIVHSNGNTYLEWFQQRPGQSPRLLIYQVSNRFSGVPDRFSGSGSGTDFTLKISRVEAEDVGVYYCFQGSHVPRTFGGGTKVEIKRGGGGSGGGGSGGGGSQIQLVQSGSELKKPGASVKVSCKASGYTFTNYGMNWVRQAPGQGLKWMGWINTNTGEPKYAEEFKGRFALSLDTSVSTAYLQINSLKAEDTAVYFCARGYGNYARGAWLAYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5573 - protein, 1140 aa, Artificial Sequence
  Synthetic Polypeptide encoding a CAR with optional accessory module(s)
MALPVTALLLPLALLLHAARPDEIVLTQSPATLSLSPGERATLSCSASSSINYIYWLQQKPGQAPRILIYLTSNLASGVPARFSGSGSGTDFTLTISSLEPEDFAVYYCLQWSSNPLTFGGGTKVEIKGGGGSGGGGSGGGGSFEVQLVESGGGLVKPGGSLRLSCAASGFTFSSYDMSWVRQAPGKGLEWVSTISSGGSYTYYLDSIKGRFTISRDNAKNSLYLQMNSLRAEDTAVYYCARQGLDYWGRGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5574 - protein, 1148 aa, Artificial Sequence
  Synthetic Polypeptide encoding a CAR with optional accessory module(s)
MALPVTALLLPLALLLHAARPDIVMTQSPDSLAVSLGERATINCRASKSVSTSGYSFMHWYQQKPGQPPKLLIYLASNLESGVPDRFSGSGSGTDFTLTISSLQAEDVAVYYCQHSREVPWTFGQGTKVEIKRGGGGSGGGGSGGGGSQVQLVQSGAEVKKPGASVKVSCKASGYTFTNYGMNWVRQAPGQGLEWMGWINTYTGEPTYADAFKGRFAFSLDTSTSTAYLQINSLRSDDTAVYYCARDYGDYGMDYWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5575 - protein, 1144 aa, Artificial Sequence
  Synthetic Polypeptide encoding a CAR with optional accessory module(s)
MALPVTALLLPLALLLHAARPDIVMTQTPLTLSVTIGQPASISCKSSQSLLDSDGKTYLNWLLQRPGQSPERLIYLVSKLDSGVPDRFTGSGSGTDFTLKISRVEAEDLGVYCCWQGTHFPYTFGGGTKVEIKGGGGGSGGGGSGGGGSQVQLQQPGAELVRPGASVKLSCKASGYTFTSYWMNWVKQRPGQGLEWIGMIDPSDSETHYNHIFKDKATLTVDKSSSTAYLQLSSLTSEDSAVYYCARNLYLWGQGTSVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5576 - protein, 1148 aa, Artificial Sequence
  Synthetic Polypeptide encoding a CAR with optional accessory module(s)
MALPVTALLLPLALLLHAARPDDIQLTQSPSSLSASVGDRVTITCKASQSVDYEGDSFLNWYQQKPGKAPKLLIYAASNLESGVPSRFSGSGSGTDFTLTISSLQPEDFATYYCQQSNEDPLTFGQGTKVEIKRGGGGSGGGGSGGGGSEVQLVESGGGLVQPGGSLRLSCAASGYTFSSYWIEWVRQAPGKGLEWIGEILPGGGDTNYNEIFKGRATFSADTSKNTAYLQMNSLRAEDTAVYYCTRRVPIRLDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5577 - protein, 1144 aa, Artificial Sequence
  Synthetic Polypeptide encoding a CAR with optional accessory module(s)
MALPVTALLLPLALLLHAARPDIVMTQTPLSLSVTPGQPASISCKSSQSLLDGDGKTYLNWLLQKPGQSPQRLIYLVSKLDSGVPDRFSGSGSGTDFTLKISRVEAEDVGVYYCWQGTHFPRTFGQGTKLEIKGGGGSGGGGSGGGGSQVQLVQSGAEVKKPGASVKVSCKASGYTFKDTYIHWVRQAPGQGLEWMGRIDPANGNTKYDPKFQGRVTMTRDTSISTAYMELSRLRSDDTAVYYCARRGGVDWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5578 - protein, 1152 aa, Artificial Sequence
  Synthetic Polypeptide encoding a CAR with optional accessory module(s)
MALPVTALLLPLALLLHAARPDIVMTQSPDSLAVSLGERATINCESSQSLLNSGNQKNYLTWYQQKPGQPPKPLIYWASTRESGVPDRFSGSGSGTDFTLTISSLQAEDVAVYYCQNDYSYPYTFGQGTKLEIKRGGGGSGGGGSGGGGSEVQLVQSGAEVKKPGESLKISCKGSGYSFTDYYMKWARQMPGKGLEWMGDIIPSNGATFYNQKFKGQVTISADKSISTTYLQWSSLKASDTAMYYCARSHLLRASWFAYWGQGTMVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5579 - protein, 1147 aa, Artificial Sequence
  Synthetic Polypeptide encoding a CAR with optional accessory module(s)
MALPVTALLLPLALLLHAARPDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKGGGGSGGGGSGGGGSQIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5580 - protein, 1151 aa, Artificial Sequence
  Synthetic Polypeptide encoding a CAR with optional accessory module(s)
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKGGGGSGGGGSGGGGSEVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5581 - protein, 1151 aa, Artificial Sequence
  Synthetic Polypeptide encoding a CAR with optional accessory module(s)
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKGGGGSGGGGSGGGGSQVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5582 - protein, 1145 aa, Artificial Sequence
  Synthetic Polypeptide encoding a CAR with optional accessory module(s)
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQDYGFPWTFGQGTKVEIKRGGGGSGGGGSGGGGSEVQLVQSGAEVKKPGESLKISCKGSGYSFTSYWISWVRQMPGKGLEWMGIIDPSDSDTRYSPSFQGQVTISADKSISTAYLQWSSLKASDTAMYYCARGDGSTDLDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5583 - protein, 1147 aa, Artificial Sequence
  Synthetic Polypeptide encoding a CAR with optional accessory module(s)
MALPVTALLLPLALLLHAARPQFVLTQPPSVSTNPGSTVKLSCKRNTGNIGSNYVNWYQQKPGQSPTTMIYRDDKRPDGVPDRFSGSIDRSSNSALLTINNVQTEDEADYFCQSYSSGINIIFGGGTKLTVLGGGGSGGGGSGGGGSQVQLQESGPGLVKPSETLSLTCTVSGFSLTTYDVHWVRQPPGKGLEWMGRIQNAGITDYNSALKSRLIISRDTSKSQVFLKMNSVTTADTAMYFCAKTGSYFYAFDHWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5584 - protein, 1144 aa, Artificial Sequence
  Synthetic Polypeptide encoding a CAR with optional accessory module(s)
MALPVTALLLPLALLLHAARPDIQMTQSPASLSASLGETVTIECRPSEDIHSNVAWYQQKPGNSPQLLIYDASNLADGVPSRFSGSGSGTQYSLKINSLQSEDVASYFCHQYNIYPYTFGSGTKLELKGGGGSGGGGSGGGGSQVQLQESGPTLVKPGDSVKMSCKASGYTFTDYIIHWVKQSHGKSLEWIGYINPYSDGTNYNEKFKSKATLTVDKSTSTAYMEFSRLTSEDSAIYFCALNYGSYYAMDAWGQGTSVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5585 - protein, 1145 aa, Artificial Sequence
  Synthetic Polypeptide encoding a CAR with optional accessory module(s)
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGQGTKVEIKRGGGGSGGGGSGGGGSEVQLLESGGGLVQPGGSLRLSCAASGFTFSGYWMHWVRQAPGKGLEWVSAIRSDGSSKYYADSVKGRFTISRDNSKNTLYLQMNSLRAEDTAVYYCAKDGVIEDTFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5586 - protein, 1141 aa, Artificial Sequence
  Synthetic Polypeptide encoding a CAR with optional accessory module(s)
MALPVTALLLPLALLLHAARPDVQITQSPSYLAASPGETITINCRASKSISKDLAWYQEKPGKTNKLLIYSGSTLQSGIPSRFSGSGSGTDFTLTISSLEPEDFAMYYCQQHNKYPYTFGGGTKLEIKRGGGGSGGGGSGGGGSQVQLQQPGAELVRPGASVKLSCKASGYTFTSYWMNWVKQRPDQGLEWIGRIDPYDSETHYNQKFKDKAILTVDKSSSTAYMQLSSLTSEDSAVYYCARGNWDDYWGQGTTLTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5587 - protein, 1172 aa, Artificial Sequence
  Synthetic Polypeptide encoding a CAR with optional accessory module(s)
MALPVTALLLPLALLLHAARPYINIYNAEPANPSEKNSPTQYAYGSGEFDIQMTQSPASLSASLGETVTIECRTSKDIYSNLAWFQQEPGNSPQLLIYDASNLADGVPSRFSGSGSGTQYSLQINNLQSEDVASYFCHQYNNYPYTFGTGTKLELKGGGGSGGGGSGGGGSQVQLQESGPTLVNPGDSVKMSCKASGYTFTDHIIHWVKQSHGKSLEWIGYINPYSGGANYNGKFKSKATLTIDKSSSTAYMEFSRLTSGDSAIYYCALNYGSYYAMDAWGQGTSVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5588 - protein, 1143 aa, Artificial Sequence
  Synthetic Polypeptide encoding a CAR with optional accessory module(s)
MALPVTALLLPLALLLHAARPEIVLTQSPTSMTASPGEQVTITCRASSSINYMHWYQQKPGASPRPWIYETSKLASGVPDRFSGSASGTSYSLTINNMEAEDAATYYCQQWNYPSWTFGGGTKLELKGGGGSGGGGSGGGGSEVQLVESGGGLVQPGRSLKLSCAASGFTFSDYNMAWVRQAPKKGLEWVATILYDGGRTYYRGSVKGRFTISRDNAKSTLYLRMDSLRSEDTATYYCATHSRGTDYFDYWGQGVMVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5589 - protein, 1152 aa, Artificial Sequence
  Synthetic Polypeptide encoding a CAR with optional accessory module(s)
MALPVTALLLPLALLLHAARPDIVMTQSPSSLAVSEGETVTINCKSSQSFLSSGDGKNYVAWYQYKPGQSPKLLIYWASTRQSGVPDRFIGSGSGTDFTLTISTVQAEDLAIYYCQQYYDTPLTFGSGTKLEIKGGGGSGGGGSGGGGSEVKLQESGPSLVQSSQTLSLTCTVSGFSLTSYHIHWVRQTPGKGLEWMGVMWSDGDTSYNSALKSRLSISRDTSQSQVFLKMNSLQTEDTATYYCARGYYSSYLYLWFAYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5590 - protein, 1156 aa, Artificial Sequence
  Synthetic Polypeptide encoding a CAR with optional accessory module(s)
MALPVTALLLPLALLLHAARPDVLMTQTPVSLPVSLGGQVSISCRSSQSLVHSDGDTYLHWYLQKPGQSPQLLIYRVSNRFSGVPDRFSGSGSGTDFTLKISRVEPEDLGLYYCLQTTHFPPWTFGGGTKLEMKGGGGSGGGGSGGGGSQVQLQQSGPELRRPGSSVRLSCKASGYRIKDFLIHWIKNRPEHGLEWIGWIDPEDGETKYAQKFQTKATLTADTSSNTAYMQLSSLTSEDTATYFCARWGDVYYGLMRGHVMDAWGQGTSVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5591 - protein, 1147 aa, Artificial Sequence
  Synthetic Polypeptide encoding a CAR with optional accessory module(s)
MALPVTALLLPLALLLHAARPDIQMTQSTSSLSASLGDRVTISCSASQGINNYLNWYQQKPDGTVELLIYYTSTLQSGVPSRFSGSGSGTDYSLTISNLEPEDIGTYYCQQYSKLPRTFGGGTKLEIKGGGGSGGGGSGGGGSQVQLQQSGSELMMPGASVKISCKATGYTFSNYWIEWVKQRPGHGLEWIGEILPGTGRTIYNEKFKGKATFTADISSNTVQMQLSSLTSEDSAVYYCARRDYYGNFYYAMDYWGQGTSVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5592 - protein, 1142 aa, Artificial Sequence
  Synthetic Polypeptide encoding a CAR with optional accessory module(s)
MALPVTALLLPLALLLHAARPDIQMTQSPASLSVSVGETVTITCRASENIYSNLAWYQQKQGKSPQLLVYAATNLADGVPSRFSGSGSGTQYSLKINSLQSEDFGSYYCQHFWGTWTFGGGTTLEIKGGGGSGGGGSGGGGSEVQLQQSGPELVKPGASVKMSCKASGYTFTDYYMKWMKQSHGKSLEWIGDINPNNGGTTYNQKFKGKATLTVDKSSSTAYMQLNSLTSEDSAVYYCARDYGYGYFDYWGQGTTLTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5593 - protein, 1145 aa, Artificial Sequence
  Synthetic Polypeptide encoding a CAR with optional accessory module(s)
MALPVTALLLPLALLLHAARPEIVLTQSPGTLSLSPGERATLSCRASQSVGGYLAWYQQKPGQAPRLLIYDASNRATGIPARFSGSGSGTDFTLTISSLEPEDFAVYYCQQRNNWPPMYTFGQGTKLEIKRGGGGSGGGGSGGGGSQVQLVQSGAEVKKPGSSVKVSCKASGGTFSSYAISWVRQAPGQGLEWMGGIIPILGTANYAQKFQGRVTITADESTSTAYMELSSLRSEDTAVYYCARWGGGAFDIWGQGTMVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5594 - protein, 1140 aa, Artificial Sequence
  Synthetic Polypeptide encoding a CAR with optional accessory module(s)
MALPVTALLLPLALLLHAARPQIVLTQSPALMSASPGEKVTMTCSASSSVRYMYWYQQKPRSSPKPWIHLTSNLASGVPARFSGSGSGTSYSLTISSMEAEDAATYYCQQWSSHPFTFGSGTKLEIKGGGGSGGGGSGGGGSDVQLQESGPGLVKPSQSLSLTCTVTGFSITSDYSWNWIRQFPGNKLEWMGYISYSGHTSYNPSLESRISITRDTSKNQFFLQLNSVTTEDTATYYCTRGNWDVVYWGQGTLVTVSATREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5595 - protein, 1150 aa, Artificial Sequence
  Synthetic Polypeptide encoding a CAR with optional accessory module(s)
MALPVTALLLPLALLLHAARPDVVMTQSPLSLPVTLGQPASISCRSSQSIVHSDGNTYLEWYQQRPGQSPRRLIYKVSNRFSGVPDRFSGSGSGTDFTLKISRVEAEDVGVYYCFQGSHAPWTFGGGTKVEIKGGGGSGGGGSGGGGSEVQLVESGGGLVQPGGSLRLSCAASGFTFSSYGMHWVRQAPGKGLEWVAYITTRSSTIYYADSVKGRFTISRDNAKNSLYLQMNSLRAEDTAVYYCTREPLTGYYAMDYWGQGTSVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5596 - protein, 1142 aa, Artificial Sequence
  Synthetic Polypeptide encoding a CAR with optional accessory module(s)
MALPVTALLLPLALLLHAARPDIQMTQSPSSLSASVGDRVTITCRASQSISLWLNWYQQKPGKAPKLLIYAASTLQSGVPSRFSGSGSGTDFTLTISSLQPEDFATYYCQQYYTSPYTFGQGTKVEIKRGGGGSGGGGSGGGGSQVQLLESGGGLVQPGGSLRLSCAASGFTFSSYAMSWVRQAPGKGLEWVSVIRSSGSSTYYADSVKGRFTISRDNSKNTLYLQMNSLRAEDTAVYYCARGGGYFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5597 - protein, 1145 aa, Artificial Sequence
  Synthetic Polypeptide encoding a CAR with optional accessory module(s)
MALPVTALLLPLALLLHAARPDIQMTQSPSSLSASVGDRVTITCRASQSISSYLNWYQQKPGKAPKLLIYAVSTLQSGVPSRFSGSGSGTDFTLTISSLQPEDFATYYCQQSGTFPPTTFGQGTKVEIKRGGGGSGGGGSGGGGSQVQLLESGGGLVQPGGSLRLSCAASGFTFSSHGMHWVRQAPGKGLEWVSVISGSGSNTGYADSVKGRFTISRDNSKNTLYLQMNSLRAEDTAVYYCARQWGSYAFDSWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5598 - protein, 1155 aa, Artificial Sequence
  Synthetic Polypeptide encoding a CAR with optional accessory module(s)
MALPVTALLLPLALLLHAARPDIVMSQSPSSLAVSVGEKVTMSCKSSQSLLHSSNQKNYLAWYQQKPGQSPKVLIYWASTRESGVPDRFTGSGSGTDFTLTITSVKSEDLAVYYCQQYYSYPWTFGGGTRLEIKRGGGGSGGGGSGGGGSEVQLQQSVAELVKPGASVKMSCKVSGYTLTDHTIHWMKQRPEQGLEWIGYIYPRDGITGYNEKFKGKATLTADTSSSTAYMQLNSLTSEDSAVYFCARWGYSYRNYAYYYDYWGQGTTLTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5599 - protein, 1152 aa, Artificial Sequence
  Synthetic Polypeptide encoding a CAR with optional accessory module(s)
MALPVTALLLPLALLLHAARPEIVLTQSPGTLSLSPGERATLSCRASQSVSSSYLAWYQQKPGQAPRLLIYGTSSRATGIPDRFSGSGSGTDFTLTISRLEPEDFAVYYCQQYGSSPFTFGGGTKVEIKRGGGGSGGGGSGGGGSQVQLQESGPGLAKPSETLSLTCTVSGDSITSYYWSWIRQPPGKGLEWIGYIYYSGSTNYNPSLKSRVTISVDTSKNQFSLKLSSVTAADTAVYYCARDQRRIAAAGTHFYGMDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5600 - protein, 1144 aa, Artificial Sequence
  Synthetic Polypeptide encoding a CAR with optional accessory module(s)
MALPVTALLLPLALLLHAARPDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKGGGGSGGGGSGGGGSQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSATREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5601 - protein, 1137 aa, Artificial Sequence
  Synthetic Polypeptide encoding a CAR with optional accessory module(s)
MALPVTALLLPLALLLHAARPMTQSPKFLLVSAGDRVTLTCKASQSVNNDVYWYQQEPGQSPKLLIYWASTRESGVPDRFTGSGSGTDFTLTISSVQAEDLAVYYCKQSYNLYTFGGGTKLEIKRGGGGSGGGGSGGGGSESGRGLVQPGGSRKLSCAASGFTFSTSGMHWVRQAPEKGLEWVAYISSGSTTIYHADTVKGRFTISRDNPKNTLFLQMTSLRSEDTAMYYCCARSGQFGNYFDYWGQGTTLTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5602 - protein, 1142 aa, Artificial Sequence
  Synthetic Polypeptide encoding a CAR with optional accessory module(s)
MALPVTALLLPLALLLHAARPQSPSSLAVSAGEKVTMSCKSSQSLLNSRTRKNYLAWYQQKPGQSPKLLIYWASTRESGVPDRFTGSGSGTDFTLTISSVQAEDLAVYYCKQSNLYTFGGGTKLEIKGGGGSGGGGSGGGGSQVQLEESGPELVKPGASVKLSCKASGYTFTEYIIHWVKQRSGQGLEWIGWFYPGSGSIKYNEKFKDKATLTADKSSSTVYMELSGLTSEDSAVYFCARHDGYSYFDYWGQGTTLTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5603 - protein, 1154 aa, Artificial Sequence
  Synthetic Polypeptide encoding a CAR with optional accessory module(s)
MEMFQGLLLLLLLSMGGTWASREMLRPRCRPINATLAVEKEGCPVCITVNTTICAGYCPTMTRVLQGVLPALPQVVCNYRDVRFESIRLPGCPRGVNPVVSYAVALSCQCALCRRSTTDCGGPKDHPLTCDDPRFQASSSSKAPPPSLPSPSRLPGPSDTPILPQGGGGSGGGGSGGGGSAPDVQDCPECTLQENPFFSQPGAPILQCMGCCFSRAYPTPLRSKKTMLVQKNVTSESTCCVAKSYNRVTVMGGFKVENHTACHCSTCYYHKSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5604 - protein, 1145 aa, Artificial Sequence
  Synthetic Polypeptide encoding a CAR with optional accessory module(s)
MALPVTALLLPLALLLHAARPDIQMTQSPSSLSASLGERVSLTCRATQELSGYLSWLQQKPDGTIKRLIYAASTLDSGVPKRFSGNRSGSDYSLTISSLESEDFADYYCLQYAIYPYTFGGGTKLEIKGGGGSGGGGSGGGGSEVQLQQSGPELVKPGASVKMSCKASGYTFTSYFIHWVKQKPGQGLEWIGFINPYNDGSKYNEKFKGKATLTSDKSSSTAYMELSSLTSEDSAVYYCTRDDGYYGYAMDYWGQGTSVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5605 - protein, 1150 aa, Artificial Sequence
  Synthetic Polypeptide encoding a CAR with optional accessory module(s)
MALPVTALLLPLALLLHAARPDTIVLTQSPASLAVSLGQRATISCRASESVDSYGNSFMHWYQQKPGQPPKLLIYLASNLESGVPARFSGSGSRTDFTLTIDPVEADDAATYYCQQNNYDPWTFGGGTKLEIKGGGGSGGGGSGGGGSEVQLQQSGPELVKPGASVKMSCKASGYTFTSYVMHWVKQKPGQGLEWIGYINPYNDGTKYNEKFKGKATLTSDTSSSTAYMELNSLTSEDSAVYFCARPIYFDNDYFDYWGQGTTLKVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5606 - protein, 1145 aa, Artificial Sequence
  Synthetic Polypeptide encoding a CAR with optional accessory module(s)
MALPVTALLLPLALLLHAARPDIQMTQSPSSLSASVGDRVTITCKASQDVSTAVAWFQQKPGKAPKLLIYSPSYRYTGVPSRFSGSGSGTDFTLTISSLQPEDFTYYCQQLYSTPYTFGQGTKVEIKGGGGSGGGGSGGGGSEVQLVQSGAEVKKPGASVKVSCKASGYTFTDYYLDVVVRQAPGQGLEWIGRVNPYNGGTIYNQKFKGRVTLTRDTSTSTAYLELSSLRSEDTAVYYCARDHYRYDPLLDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5607 - protein, 1151 aa, Artificial Sequence
  Synthetic Polypeptide encoding a CAR with optional accessory module(s)
MALPVTALLLPLALLLHAARPDIQMTQSPSSLSASVGDRVTITCRASQSVSTSSYNYMHWYQQKPGKPPKLLIKYASNLESGVPSRFSGSGSGTDFTLTISSLQPEDFATYYCQHSWEIPLTFGQGTKVEIKGGGGSGGGGSGGGGSEVQLVQSGAEVKKPGASVKVSCKASGYSFTDYYMHWVRQAPGQGLEWIGRINPYNGAAFYSQNFKDRVTLTVDTSTSTAYLELSSLRSEDTAVYYCAIERGADLEGYAMDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5608 - protein, 1149 aa, Artificial Sequence
  Synthetic Polypeptide encoding a CAR with optional accessory module(s)
MALPVTALLLPLALLLHAARPEIVLTQSPATLSASPGERVTLTCRASSNVISSYVHWYQQKPGSSPRLFLYSTSNLASGVPSRFSGSGSGTDFTFTISSLEAEDAATYYCQQYSGYPLTFGQGTRLEIKGGGGSGGGGSGGGGSQVQLQESGPGLVKPSETLSLTCAVSGYSITSAYYWNWIRQPPGKGLEWIGYISYDGRNNYNPSLKNRITINPDTSKNQFSLQLNSVTPEDTAVYYCAREGDYDVGNYYAMDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5609 - protein, 1149 aa, Artificial Sequence
  Synthetic Polypeptide encoding a CAR with optional accessory module(s)
MALPVTALLLPLALLLHAARPEIVLTQSPATLSLSPGERATLSCRASSNVISSYVHWYQQKPGQAPRLLIYSTSNLASGIPARFSGSGSGTDFTLTISSLEPEDFAVYYCQQYSGYPLTFGQGTRLEIKGGGGSGGGGSGGGGSEVQLVESGGGLVQPGRSLRLSCAASGYSITSAYYWNWVRQAPGKGLEWVSYISYDGRNNYNPSLKNRFTISRDNAKKSLYLQMNSLRAEDTALYYCAKEGDYDVGNYYAMDYWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5610 - protein, 1161 aa, Artificial Sequence
  Synthetic Polypeptide encoding a CAR with optional accessory module(s)
MALPVTALLLPLALLLHAARPDLNFMLTQPHSVSGSPGKTVTISCTRSTGSITSNYVHWYQQRPGSSPTTVICEDNERPSGVPDRFSGSIDISSNSASLTISGLKTEDEADYYCQSYDDSNHISVFGTGTKVTVLGQPKANPGGGGSGGGGSGGGGSQVQLQESGPGLVKPSETLSLTCTVSGGSISSSNYYWGWIRQPPGKGLEWIGAIYYSGSTYYNPSLKSRVAISVDTSKNQFSLKLSSVTAADTAVYYCARRIGVAGQWYFDLWGRGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5611 - protein, 1147 aa, Artificial Sequence
  Synthetic Polypeptide encoding a CAR with optional accessory module(s)
MALPVTALLLPLALLLHAARPDIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIKGGGGSGGGGSGGGGSQIQLVQSGPDLKKPGETVKISCKASGYTFTNTGMNWVKQAPGKGLKWMGWINTYTGEPTYADDFKGRFTFSLETSASTAYLQINNLKNEDTATYFCTRWGYGSSLYYAMDYWGQGTSVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5612 - protein, 1144 aa, Artificial Sequence
  Synthetic Polypeptide encoding a CAR with optional accessory module(s)
MALPVTALLLPLALLLHAARPDIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIKGGGGSGGGGSGGGGSEVQLVESGGGLVQPGGSLRLSCAASGFDFSRYWMSWVRQAPGKGLEWIGEINPDSSTINYAPSLKDKFIISRDNAKNSLYLQMNSLRAEDTAVYYCARPDGNYWYFDVWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5613 - protein, 1145 aa, Artificial Sequence
  Synthetic Polypeptide encoding a CAR with optional accessory module(s)
MALPVTALLLPLALLLHAARPDIVMTQSQKSMSTSVGDRVSITCKASQDVITGVAWYQQKPGQSPKLLIYSASYRYTGVPDRFTGSGSGTDFTFTISNVQAEDLAVYYCQQHYSTPLTFGAGTKLELKGGGGSGGGGSGGGGSQVQLQQPGAELVRPGASVKLSCKASGYSFTTYWMNWVKQRPGQGLEWIGMIHPSDSETRLNQKFKDKATLTVDKSSSTAYMQLSSPTSEDSAVYYCARSTMIATRAMDYWGQGTSVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5614 - protein, 1147 aa, Artificial Sequence
  Synthetic Polypeptide encoding a CAR with optional accessory module(s)
MALPVTALLLPLALLLHAARPDIQMTQSPSSLSASVGDRVTITCKASQDVSTAVAWYQQKPGKAPKLLIYSASYRYTGVPDRFTGSGSGTDFTLTISSLQPEDFATYYCQQHYSTPPYTFGGGTKVEIKRGGGGSGGGGSGGGGSQVQLVQSGAEVKKPGASVKVSCKASGYAFSSSWMNWVRQAPGQGLEWIGRIYPGDGDTKYNGKFKGKATLTADKSTSTAYMELSSLRSEDTAVYYCARSTMIATGAMDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5615 - protein, 1148 aa, Artificial Sequence
  Synthetic Polypeptide encoding a CAR with optional accessory module(s)
MALPVTALLLPLALLLHAARPDVVMTQTPLSLSVTPGQPASISCRSSQSLVHNNGNTYLHWYLQKPGQSPQLLIYKVSNRFSGVPDRFSGSGSGTDFTLKISRVEAEDVGVYFCSQSTHVPPYTFGGGTKVEIKGGGGSGGGGSGGGGSEVQLVESGGGLVQPGGSLRLSCAASGFTFSDYYMAWVRQAPGKGLEWVAEINYDGSSTYYVDSVKGRFTISRDNAKNSLYLQMNSLRAEDTAVYYCARDRGFYFDYWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5616 - protein, 1148 aa, Artificial Sequence
  Synthetic Polypeptide encoding a CAR with optional accessory module(s)
MALPVTALLLPLALLLHAARPDVVMTQTPLSLSVTPGQPASISCRSSQSLVHSNGLTYLHWYLQKPGQSPQLLIYKVSNRFSGVPDRFSGSGSGTDFTLKISRVEAEDVGVYFCSQSTHVPPFTFGGGTKVEIKGGGGSGGGGSGGGGSEVQLVESGGGLVQPGGSLRLSCAASGFTFSDYYMAWVRQAPGKGLEWVASINYDGESTYYVDSVKGRFTISRDNAKNSLYLQMNSLRAEDTAVYYCARDRGYYFDYWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5617 - protein, 1148 aa, Artificial Sequence
  Synthetic Polypeptide encoding a CAR with optional accessory module(s)
MALPVTALLLPLALLLHAARPDVVMTQSPLSLPVTPGEPASISCRSSQSLVHSNGNTYLHWYLQKPGQSPQLLIYKVSNRFSGVPDRFSGSGSGTDFTLKISRVEAEDVGVYFCSQSTHVPPFTFGGGTKVEIKGGGGSGGGGSGGGGSEVQLVESGGGLVQPGGSLRLSCAASGFTFSDYYMAWVRQAPGKGLEWVADINYDGGSTYYLDSLKSRFTISRDNAKNSLYLQMNSLRAEDTAVYYCARDRGYYFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5618 - protein, 1146 aa, Artificial Sequence
  Synthetic Polypeptide encoding a CAR with optional accessory module(s)
MALPVTALLLPLALLLHAARPDIQMTQSSSYLSVSLGGRVTITCKASDHINNWLAWYQQKPGNAPRLLISGATSLETGVPSRFSGSGSGKDYTLSITSLQTEDVATYYCQQYWSTPWTFGGGTKLEIKGGGGSGGGGSGGGGSQVQLQQSGAELARPGASVKLSCKASGYTFTSYWMQWVKQRPGQGLEWIGAIYPGDGDTRYTQKFKGKATLTADKSSSTAYMQLSSLASEDSAVYYCARGKVYYGSNPFAYWGQGTLVTVSATREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5619 - protein, 1146 aa, Artificial Sequence
  Synthetic Polypeptide encoding a CAR with optional accessory module(s)
MALPVTALLLPLALLLHAARPDIVMTQSHKFMSTSVGDRVSITCKASQDVSTAVAWYQQKPGQSPKLLIYSASYRYTGVPDRFTGSGSGTDFTFTISSVQAEDLAVYYCQQHYSTPPYTFGGGTKLEIKGGGGSGGGGSGGGGSQVQLQQSGPELVKPGASVKISCKASGYAFSSSWMNWVKQRPGQGLEWIGRIYPGDGDTKYNGKFKGKATLTADKSSSTAYMQLSSLTSVDSAVYFCARSTMIATGAMDYWGQGTSVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5620 - protein, 1151 aa, Artificial Sequence
  Synthetic Polypeptide encoding a CAR with optional accessory module(s)
MALPVTALLLPLALLLHAARPQSVLTQPPSVSGAPGQRVTISCTGSGSNIGAPYDVSWYQQLPGTAPKLLIYHNNKRPSGVPDRFSGSKSGTSASLAITGLQAEDEADYYCATVEAGLSGSVFGGGTKLTVLGAGGGGSGGGGSGGGGSQVQLVQSGAEVKKPGASVKVSCKVSGYTLTELSIHWVRQAPGKGLEWMGGFDPEENEIVYAQRFQGRVTMTEDTSTDTAYMELSSLRSEDTAVYYCAIVGSFSPLTLGLWGQGTMVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5621 - protein, 1151 aa, Artificial Sequence
  Synthetic Polypeptide encoding a CAR with optional accessory module(s)
MALPVTALLLPLALLLHAARPQSVLTQPPSVSGAPGQRVTISCTGSGSNIGAPYDVSWYQQLPGTAPKLLIYHNNKRPSGVPDRFSGSKSGTSASLAITGLQAEDEADYYCQSYDSSSISTIFGGGTKLTVLGAGGGGSGGGGSGGGGSQVQLVQSGAEVKKPGASVKVSCKVSGYTLTELSIHWVRQAPGKGLEWMGGFDPEENEIVYAQRFQGRVTMTEDTSTDTAYMELSSLRSEDTAVYYCAIVGSFSGIAYRPWGQGTMVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5622 - protein, 1162 aa, Artificial Sequence
  Synthetic Polypeptide encoding a CAR with optional accessory module(s)
MALPVTALLLPLALLLHAARPDEFEVQLVESGGGLVQAGGSLRLSCVASGISSSKRNMGWYRQAPGKQRESVATISSGGNKDYTDAVKDRFTISRDTTKNTVYLQMNSLKPEDTAVYYCKIEAGTGWATRRGYTYWGQGTLVTVSSLEGGGGSGGGGSGGGGSFEVQLVESGGGLVQAGGSLRLSCAASGSIFSGNVMGWYRRQAPGKEREWVAAIASGGSIYYRDSVKGRFTISRDNAKNTVYLQMNSLKPEDTAVYYCNSHPPTLPYWGLGTQVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5623 - protein, 1196 aa, Artificial Sequence
  Synthetic Polypeptide encoding a CAR with optional accessory module(s)
MALPVTALLLPLALLLHAARPDEFEVQLVESGGGLVQAGDSLRLSCAASGRAFSRYAMGWFRQAPGKEREFVAAIGWGPSKTNYADSVKGRFTISRDNAKNTVYLQMNTLKPEDTAVYSCAAKFVNTDSTWSRSEMYTYWGQGTLVTVSSLEGGGGSGGGGSGGGGSGSGGSGSGGSGSGGSGSGGSFEVQLVESGGGSVQAGGSLRLSCTTSGRALNMYVMGWFRQAPGNEREFVAATSSSGGSTSYPDSVKGRFTISRDNAKNTVYLQMNSLKPEDTAAYRCAASPYVSTPTMNILEEYRYWGLGTQVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5624 - protein, 1149 aa, Artificial Sequence
  Synthetic Polypeptide encoding a CAR with optional accessory module(s)
MALPVTALLLPLALLLHAARPDIQMTQSPSSLSASVGDRVTITCSASSSVSYMYWYQQKPGKAPKLLIYLTSNLASGVPSRFSGSGSGTDFTLTISSLQPEDFATYYCQQWRSNPFTFGQGTKLEIKRGGGGSGGGGSGGGGSQITLKESGPTLVKPTQTLTLTCTFSGFSLSTSGMGVGWIRQPPGKALEWLAHIWWDDVKRYSPSLKSRLTITKDTSKNQVVLTMTNMDPVDTATYYCARIVSFDNDVVSAMDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5625 - protein, 1144 aa, Artificial Sequence
  Synthetic Polypeptide encoding a CAR with optional accessory module(s)
MALPVTALLLPLALLLHAARPEIVMTQSPATLSVSPGERATLSCKASQSVSNDVVWYQQKPGQAPRLLIYYASNRYTGIPARFSGSGSGTEFTLTISSLQSEDFAVYYCQQDYTSPWTFGQGTKLEIKRGGGGSGGGGSGGGGSQVQLVQSGAEVKKPGASVKVSCKASGYTFTNYGMNWVRQAPGQGLEWMGWINTYTGEPTYADDFKGRVTMTTDTSTSTAYMELRSLRSDDTAVYYCARIGDSSPSDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5626 - protein, 1145 aa, Artificial Sequence
  Synthetic Polypeptide encoding a CAR with optional accessory module(s)
MALPVTALLLPLALLLHAARPDSTDIQMTQSPSSLSASVGDRVTITCRASQSISSYLNWYQQKPGKAPKLLIYLASNLQSGVPSRFSGSGSGTDFTLTISSLQPEDFATYYCQQAEYMPLTFGQGTKVEIKRAGGGGSGGGGSGGGGSEVQLLESGGGLVQPGGSLRLSCAASGFTFSGYAMSWVRQAPGKGLEWVSEIAPPGLNTRYADSVKGRFTISRDNSKNTLYLQMNSLRAEDTAVYYCAKSDTAFDYWGQGTLVTVSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5627 - protein, 1148 aa, Artificial Sequence
  Synthetic Polypeptide encoding a CAR with optional accessory module(s)
MALPVTALLLPLALLLHAARPDQAVLTQESALTTSPGETVTLTCRSSTGAVTTSNYANWVQEKPDHLFTGLIGGTNNRVPGVPARFSGSLIGDKAALTITGAQTEDEAIYFCVLWHSNHWVFGGGTKLTVLGGGGSGGGGSGGGGSDVQLVESGGGLVQPGGSRKLSCAASGFTFSSFGMHWVRQAPEKGLEWVAYISSGSSTLHYADTVKGRFTISRDNPKNTLFLQMTSLRSEDTAMYYCARWGNYPHYAMDYWGQGTSVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5628 - protein, 1030 aa, Artificial Sequence
  Synthetic Polypeptide encoding a CAR with optional accessory module(s)
MALPVTALLLPLALLLHAARPDEFEVQLVESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5629 - protein, 1172 aa, Artificial Sequence
  Synthetic Polypeptide encoding a CAR with optional accessory module(s)
MALPVTALLLPLALLLHAARPDEFEVQLVESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTLVTVSSLEGGGGSGGGGSGGGGSFEEVQLVESGGGSVQAGGSLRLSCAASGDTYGSYWMGWFRQAPGKEREGVAAINRGGGYTVYADSVKGRFTISRDTAKNTVYLQMNSLRPDDTADYYCAASGVLGGLHEDWFNYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5630 - protein, 1191 aa, Artificial Sequence
  Synthetic Polypeptide encoding a CAR with optional accessory module(s)
MALPVTALLLPLALLLHAARPDEFEVQLVESGGGSVQAGGSLRLTCAASGSTSRSYGMGWFRQAPGKEREFVSGISWRGDSTGYADSVKGRFTISRDNAKNTVDLQMNSLKPEDTAIYYCAAAAGSTWYGTLYEYDYWGQGTLVTVSSLEGGGGSGGGGSGGGGSGSGGSGSGGSGSGGSGSGGSFEVQLVESGGGSVQAGGSLRLSCAASGDTYGSYWMGWFRQAPGQEREAVAAINRGGGYTVYADSVKGRFTISRDNAKNTLYLQMNSLRPDDTADYYCAASGVLGGLHEDWFNYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5631 - protein, 1139 aa, Artificial Sequence
  Synthetic Polypeptide encoding a CAR with optional accessory module(s)
MALPVTALLLPLALLLHAARPDIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVEGGGGSGGGGSGGGGSEVQVLESGGGLVQPGGSLRLSCAASGFTFSSYAMSWVRQAPGKGLEWVSAISGSGGSTNYADSVKGRFTISRDNSKNTLYLQMNSLRAEDTAVYYCAGSSGWSEYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5632 - protein, 1145 aa, Artificial Sequence
  Synthetic Polypeptide encoding a CAR with optional accessory module(s)
MALPVTALLLPLALLLHAARPDEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSGGGGSGGGGSGGGGSDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5633 - protein, 1152 aa, Artificial Sequence
  Synthetic Polypeptide encoding a CAR with optional accessory module(s)
MALPVTALLLPLALLLHAARPDELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGGGGSGGGGSGGGGSEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5634 - protein, 1153 aa, Artificial Sequence
  Synthetic Polypeptide encoding a CAR with optional accessory module(s)
MALPVTALLLPLALLLHAARPDELQMTQSPSSLSASVGDRVTITCRASQSISSYLNWYQQKPGQPPKLLIYWASTRESGVPDRFSGSESGTNYTLTISSLQPEDFATYFCQQSDSLPITFGQGTRLDIQGGGGSGGGGSGGGGSEVQLLESGGGVVQPGRSLRLSCAASGFTFSSYGMHWVRQAPGKGLEWVAVISYDGSNKYYADSVKGRFTISRDNSKNTLYLQMNSLRAEDTAVYYCAKDMGWGSGWRPYYYYGMDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5635 - protein, 1150 aa, Artificial Sequence
  Synthetic Polypeptide encoding a CAR with optional accessory module(s)
MALPVTALLLPLALLLHAARPDDIQMTQSPSSLSASVGDRVTITCRASQSISSYLNWYQQKPGKAPKLLIYAASSLQSGVPSRFSGSGSGTDFTLTISSLQPEDLATYYCQQSYSTPFTFGPGTKVDIKGGGGSGGGGSGGGGSVHEVQLVQSGAEVKKPGSSVKVSCKASGGTFSSYAISWVRQAPGQGLEWMGGIIPIFGTANYAQKFQGRVTITADKSTSTAYMELSSLRSEDTAVYYCATFALFGFREQAFDIWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5636 - protein, 1147 aa, Artificial Sequence
  Synthetic Polypeptide encoding a CAR with optional accessory module(s)
MALPVTALLLPLALLLHAARPDVVMTQTPLSLPVSLGDQASISCRSSQSLVHSNGNTYLRWYLQKPGQSPKVLIYKVSNRFSGVPDRFSGSGSGTDFTLKISRVEAEDLGVYFCSQSTHVPWTFGGGTKLEIKGGGGSGGGGSGGGGSEVKLDETGGGLVQPGRPMKLSCVASGFTFSDYWMNWVRQSPEKGLEWVAQIRNKPYNYETYYSDSVKGRFTISRDDSKSSVYLQMNNLRVEDMGIYYCTGSYYGMDYWGQGTSVTVSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5637 - protein, 1158 aa, Artificial Sequence
  Synthetic Polypeptide encoding a CAR with optional accessory module(s)
MALPVTALLLPLALLLHAARPDVVMTQTPLSLPVSLGDQASISCRSSQSLVHSNGNTYLRWYLQKPGQSPKVLIYKVSNRVSGVPDRFSGSGSGTDFTLKINRVEAEDLGVYFCSQSTHVPWTFGGGTKLEIKSSADDAKKDAAKKDDAKKDDAKKDGGVKLDETGGGLVQPGGAMKLSCVTSGFTFGHYWMNWVRQSPEKGLEWVAQFRNKPYNYETYYSDSVKGRFTISRDDSKSSVYLQMNNLRVEDTGIYYCTGASYGMEYLGQGTSVTVSTTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5638 - protein, 1154 aa, Artificial Sequence
  Synthetic Polypeptide encoding a CAR with optional accessory module(s)
MALPVTALLLPLALLLHAARPQVQLVESGGNLVQPGGSLRLSCAASGFTFGSFSMSWVRQAPGGGLEWVAGLSARSSLTHYADSVKGRFTISRDNAKNSVYLQMNSLRVEDTAVYYCARRSYDSSGYWGHFYSYMDVWGQGTLVTVSGGGGSGGGGSGGGGSSVLTQPSSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLGTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5639 - protein, 1149 aa, Artificial Sequence
  Synthetic Polypeptide encoding a CAR with optional accessory module(s)
MALPVTALLLPLALLLHAARPDIQMTQSPSSLSASVGDRVTITCRTSQSLSSYTHWYQQKPGKAPKLLIYAASSRGSGVPSRFSGSGSGTDFTLTISSLQPEDFATYYCQQSRTFGQGTKVEIKGGGGSGGGGSGGGGSQVQLQQSGPGLVKPSQTLSLTCAISGDSVSSYNAVWNWIRQSPSRGLEWLGRTYYRSGWYNDYAESVKSRITINPDTSKNQFSLQLNSVTPEDTAVYYCARSGHITVFGVNVDAFDMWGQGTMVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5640 - protein, 1148 aa, Artificial Sequence
  Synthetic Polypeptide encoding a CAR with optional accessory module(s)
MALPVTALLLPLALLLHAARPDIVLTQSPLSLAVSLGQPAIISCKASQSVSFAGTSLMHWYHQKPGQQPRLLIYRASNLEAGVPDRFSGSGSKTDFTLTISPVEAEDAATYYCQQSREYPYTFGGGTKLEIKRGGGGSGGGGSGGGGSQVQLVQSGAEVVKPGASVKISCKASGYTFTGYFMNWVKQSPGQSLEWIGRIHPYDGDTFYNQKFQGKATLTVDKSSNTAHMELLSLTSEDFAVYYCTRYDGSRAMDYWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5641 - protein, 1121 aa, Artificial Sequence
  Synthetic Polypeptide encoding a CAR with optional accessory module(s)
MALPVTALLLPLALLLHAARPNSCELTNITIAIEKEECRFCISINTTWCAGYCYTRDLVYKDPARPKIQKTCTFKELVYETVRVPGCAHHADSLYTYPVATQCHCGKCDSDSTDCTVRGLGPSYCSFGEMKEGGGGSGGGGSGGGGSAPDVQDCPECTLQENPFFSQPGAPILQCMGCCFSRAYPTPLRSKKTMLVQKNVTSESTCCVAKSYNRVTVMGGFKVENHTACHCSTCYYHKSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5642 - protein, 1152 aa, Artificial Sequence
  Synthetic Polypeptide encoding a CAR with optional accessory module(s)
MALPVTALLLPLALLLHAARPDLETTLTQSPATLSVSPGERVTLSCRASQSVGSNLAWYQQKFGQAPRLLIYDASTRATGIPARFSGSGSGTEFTLTISRLEPEDFAVYYCHQYGSSPRTFGQGTKVDIKRGGGGSGGGGSGGGGSQVQLVQSGAEVKKPGASVKVSCKASGYTFTTYGISWVRQAPGQGLEWMGWISAYNGHTNYAQMLQGRVTMTTDTSTSTAYMELRGLRSDDTAVYYCAREAYASYGSGSYWTDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5643 - protein, 1145 aa, Artificial Sequence
  Synthetic Polypeptide encoding a CAR with optional accessory module(s)
MALPVTALLLPLALLLHAARPDDVVMTQTPLSLPVTPGEPASISCRSSQSLVHRNGNTYLHWYLQKPGQSPKLLIHKVSNRFSGVPDRFSGSGSGTDFTLKISRVEAEDLGVYFCSQSTHVPPLTFGAGTKLELKGGGGSGGGGSGGGGSEVQLVQSGAEVEKPGASVKISCKASGSSFTGYNMNWVRQNIGKSLEWIGAIDPYYGGTSYNQKFKGRATLTVDKSTSTAYMHLKSLRSEDTAVYYCVSGMEYWGQGTSVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5644 - protein, 1143 aa, Artificial Sequence
  Synthetic Polypeptide encoding a CAR with optional accessory module(s)
MALPVTALLLPLALLLHAARPDEIVMTQTPATLSVSAGERVTITCKASQSVSNDVTWYQQKPGQAPRLLIYSASNRYSGVPARFSGSGYGTEFTFTISSVQSEDFAVYFCQQDYSSFGQGTKLEIKRGGGGSGGGGSGGGGSQVQLVESGPGVVQPGRSLRISCAVSGFSVTNYGVHWVRQPPGKGLEWLGVIWAGGITNYNSAFMSRLTISKDNSKNTVYLQMNSLRAEDTAMYYCASRGGHYGYALDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5645 - protein, 1145 aa, Artificial Sequence
  Synthetic Polypeptide encoding a CAR with optional accessory module(s)
MALPVTALLLPLALLLHAARPDIQMTQTASSLPASLGDRVTISCSASQDISNYLNWYQQKPDGTVKLLIFYSSNLHSGVPSRFSGGGSGTDYSLTISNLEPEDIATYFCHQYSKLPWTFGGGTKLEIKRGGGGSGGGGSGGGGSEVTLVESGGDFVKPGGSLKVSCAASGFAFSHYAMSWVRQTPAKRLEWVAYISSGGSGTYYSDSVKGRFTISRDNAKNTLYLQMRSLRSEDSAMYFCTRVKLGTYYFDSWGQGTTLTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5646 - protein, 1147 aa, Artificial Sequence
  Synthetic Polypeptide encoding a CAR with optional accessory module(s)
MALPVTALLLPLALLLHAARPQFVLTQSPSASAALGASAKLTCTLSSAHKTYTIDWYQQQKGKAPRYLIQVKSDGTYTKATGVPDRFSGSSSGADRYLIIPSVQADDEADYYCGTDYTGGYVFGGGTQLTVTGGGGSGGGGSGGGGSEQLKESGGGLFKPTDTLTLTCTVSGFSLSYYGVNWVRQAPGNGLEWIGTIGGSGDTYYASWAKSRSTIIRNTNENTVTLKMTSLTAADTATYFCVRYANIGYEYFNVWGPGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5647 - protein, 1152 aa, Artificial Sequence
  Synthetic Polypeptide encoding a CAR with optional accessory module(s)
MALPVTALLLPLALLLHAARPQFVLTQSPSVSAALGASAKLTCTLSSAHKTYTIDWYQQQQGEAPRYLMQVKSDGSYTKGTGVPDRFSGSSSGADRYLIIPSVQADDEAGYVCGADDNGGYVFGGGTQLTVTGGGGSGGGGSGGGGSQSVKESEGGLFKPTDTLTLTCTVSGFSLSRHALTWVRQAPGNGLEWIGAIDNAGTTYYASWAKSRSTITRNTDLHTVTLKMTSLTASDTATYFCARVFYDINSGYYLDGMDLWGPGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5648 - protein, 1146 aa, Artificial Sequence
  Synthetic Polypeptide encoding a CAR with optional accessory module(s)
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKGGGGSGGGGSGGGGSEVQLVESGGGLVQPGESLRLSCVASGFTFSRYKMNWVRQAPGKGLEWVSYISRSGRDIYYADSVKGRFTISRDNAKNSLYLQMNSLRDEDTAVYYCAGTVTTYYYFGMDVWGHGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5649 - protein, 1147 aa, Artificial Sequence
  Synthetic Polypeptide encoding a CAR with optional accessory module(s)
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKGGGGSGGGGSGGGGSEVQLVESGGGSVQPGESLRLSCVASGFTFSRYKMNWVRQAPGKGLEWVSYISRSGRDIYYADSVKGRFTISRDNAKNSLYLQMNSLRDEDTAVYYCAGTVTTYYYDFGMDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5650 - protein, 1146 aa, Artificial Sequence
  Synthetic Polypeptide encoding a CAR with optional accessory module(s)
MALPVTALLLPLALLLHAARPQSVLTQPPSASGTPGQRVTISCSGSRSNVGGNYVFWYQQVPGATPKLLIYRSNQRPSGVPDRFAGSKSGSSASLAISGLRSEDEADYYCATWDDSLSGFVFGTGTKVTVLGGGGGSGGGGSGGGGSEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARGYGKAYDQWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5651 - protein, 1145 aa, Artificial Sequence
  Synthetic Polypeptide encoding a CAR with optional accessory module(s)
MALPVTALLLPLALLLHAARPQSVVTQPPSMSAAPGQQVTISCSGGNSNIERNYVSWYLQLPGTAPKLVIFDNDRRPSGIPDRFSGSKSGTSATLGITGLQTGDEADYYCGTWDSSLRGWVFGGGTKLTVLGGGGGSGGGGSGGGGSEVQLVESGGGLIQPGGSLRLSCAASGFTFSNYAMNWVRQAPGKGLEWVSTINGRGSSTIYADSVKGRFTISRDNSKNTLYLQMNSLRAEDTATYYCARYISRGLGDSWGQGTLVTVTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5652 - protein, 1145 aa, Artificial Sequence
  Synthetic Polypeptide encoding a CAR with optional accessory module(s)
MALPVTALLLPLALLLHAARPQSVVTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSYVFGTGTKLTVLGGGGGSGGGGSGGGGSEVQLVETGGNLVQPGASLRLSCAASGFSFSGTAMHWVRQAPGKGLEWVSTISSTGRSTYYRDSVKGRFTISRDNSKNTLYLQMNSLRGEDTAVYYCARVSFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5653 - protein, 1147 aa, Artificial Sequence
  Synthetic Polypeptide encoding a CAR with optional accessory module(s)
MALPVTALLLPLALLLHAARPQSVVTQPASVSGSPGQSITISCTGTSSDVGGYNYVSWYQQHPGKAPKLMIYDVSKRPSGVSNRFSGSKSGNTASLTISGLQAEDEADYYCSSYTSSSTLVFGGGTKLTVLGGGGGSGGGGSGGGGSEVQLVESGGAFVQPGGSLRLSCAASGFTFSSYAMTWVRQAPGKGLEWVSTISGRGRSTFYADSVKGRFTISRDNSKNTLYLQMNSLRAEDTAVYYCARYYHAGAFDLWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5654 - protein, 1145 aa, Artificial Sequence
  Synthetic Polypeptide encoding a CAR with optional accessory module(s)
MALPVTALLLPLALLLHAARPDNIELTQSPAIMSASPGERVTMTCSASSSIRYIYWYQQKPGSSPRLLIYDTSNVAPGVPFRFSGSGSGTSYSLTINRMEAEDAATYYCQEWSGYPYTFGGGTKLDIKRGGGGSGGGGSGGGGSQVKLQESGGGLVKPGGSLKLSCAASGFTFSSYGMSWVRQTPDKRLEWVATISSGGSYTYYPDSVKGRFTISRDNAKNTLYLQMSSLKSEDTAMYYCARGNWEGWYFDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5655 - protein, 1155 aa, Artificial Sequence
  Synthetic Polypeptide encoding a CAR with optional accessory module(s)
MALPVTALLLPLALLLHAARPDNFMLTQPHSVSESPGKTVTISCTGSGGSIDNNYVHWYQQRPGSAPTTVMFEDNQRPSGVPDRFSGSIDSSSNSASLVISGLKTEDEGDYYCQSSDGSKVVFGGGTKLTVLGQGGGGSGGGGSGGGGSEVQLVQSGGGSLTLSCAASGVVQPGRFTFSSYGMHWVRQAPGKGLEWVSVISYDGSNKYYADSVKGRFTISRDNSKNTLYLQMNSLRTEDTAVYYCAKTLSAGEWIGGGAFDIWGHGTMVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5656 - protein, 1145 aa, Artificial Sequence
  Synthetic Polypeptide encoding a CAR with optional accessory module(s)
MALPVTALLLPLALLLHAARPDVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQNTPVPPKFGSGTKLEIKGGGGSGGGGSGGGGSQVQLQQSGAELVRPGASVKLSCKASGYTFNDYEMHWVKQTPVHGLKWIGALEPKTGDTAYSQKFKGKATLTADKSSSTAYMELRSLTSEDSAVYYCTSCYYYTYSGQGTLVTVSATREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5657 - protein, 1144 aa, Artificial Sequence
  Synthetic Polypeptide encoding a CAR with optional accessory module(s)
MALPVTALLLPLALLLHAARPDIQLTQSPSSLSASVGDRVTITCRASQGIRNDLGWYQQKPGKAPKRLIYAASSLQNGVPSRFSGSGSGTEFTLTISSLQPEDFATYYCLQHNTYPAFGQGTKVEIKRGGGGSGGGGSGGGGSQVQLQESGPGLVKPSQTLSLTCTVSGGSISSFNYYWSWIRHHPGKGLEWIGYIYYSGSTYSNPSLKSRVTISVDTSKNQFSLTLSSVTAADTAVYYCARGYNWNYFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5658 - protein, 1146 aa, Artificial Sequence
  Synthetic Polypeptide encoding a CAR with optional accessory module(s)
MALPVTALLLPLALLLHAARPDDIVLTQSPASLAVSLGQSVTISCRASESVEYYGTSLMQWYQQKPGQPPKLLIYATSNVESGVPARFSGSGSGTDFSLNIHPVEEDDIAMYFCQQSRKLPSTFGGGTKLEIKGGGGSGGGGSGGGGSDVRLQESGPGQVKPSQTVSLTCSVTGYSITNGNHWWNWIRQVSGSKLEWIGYISSSGSTDSNPSLKSRISITRDTSKNQLFLQLNSVTTEDIATYYCARGYYFDYWGQGTTLTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5659 - protein, 1024 aa, Artificial Sequence
  Synthetic Polypeptide encoding a CAR with optional accessory module(s)
MALPVTALLLPLALLLHAARPDEFEVQLVESGGGLVQAGGSLRLSCAASGITFSINTMGWYRQAPGKQRELVALISSIGDTYYADSVKGRFTISRDNAKNTVYLQMNSLKPEDTAVYYCKRFRTAAQGTDYWGQGTQVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5660 - protein, 959 aa, Artificial Sequence
  Synthetic Polypeptide encoding a CAR with optional accessory module(s)
MDWIWRILFLVGAATGAHSFEGSGFEYAKEMRNAYWEIALLPNLTNQQKRAPIRKLYDDPSQSSELLSEAKKLNDSQTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5661 - protein, 1030 aa, Artificial Sequence
  Synthetic Polypeptide encoding a CAR with optional accessory module(s)
MALPVTALLLPLALLLHAARPDEFGSDLGIKLLFAAAKGQDDEVRILLAAGADVNAKDFEGYTPLHVAAYDGHLEIVEVLLKAGADVNAKDSQGRTPLHEAAYSGHLEIVEVLLKAGADVNAQDDAGETPADLAAAWGHEDIAEVLQKTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5662 - protein, 1029 aa, Artificial Sequence
  Synthetic Polypeptide encoding a CAR with optional accessory module(s)
MDWIWRILFLVGAATGAHSFERSDLGKKLLEAARAGQDDEVRILMANGADVNAKDEYGLTPLYLATAHGHLEIVEVLLKNGADVNAVDAIGFTPLHLAAFIGHLEIAEVLLKHGADVNAQDKFGKTAFDISIGNGNEDLAEILQKLNTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5663 - protein, 1181 aa, Artificial Sequence
  Synthetic Polypeptide encoding a CAR with optional accessory module(s)
MALPVTALLLPLALLLHAARPDEFEVQLVESGGGLVQAGGSLRLSCAASGITFSINTMGWYRQAPGKQRELVALISSIGDTYYADSVKGRFTISRDNAKNTVYLQMNSLKPEDTAVYYCKRFRTAAQGTDYWGQGTQVTVSSLEGGGGSGGGGSGGGGSGSGGSGSGGSGSGGSGSGGSFEVQLVESGGGLVQPGGSLRLSCAASGSIFGFNDMAWYRQAPGKQRELVALISRVGVTSSADSVKGRFTISRVNAKDTVYLQMNSLKPEDTAVYYCYMDQRLDGSTLAYWGQGTQVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5664 - protein, 1145 aa, Artificial Sequence
  Synthetic Polypeptide encoding a CAR with optional accessory module(s)
MALPVTALLLPLALLLHAARPDIQMTQSPSSLSASVGDRVTITCRASQDVNTAVAWYQQKPGKAPKLLIYSASFLESGVPSRFSGSRSGTDFTLTISSLQPEDFATYYCQQHYTTPPTFGQTKVEIKRGGGGSGGGGSGGGGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDVWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5665 - protein, 1024 aa, Artificial Sequence
  Synthetic Polypeptide encoding a CAR with optional accessory module(s)
MALPVTALLLPLALLLHAARPDEFDVQLVESGGGLVQPGGSLRLSCAASGSIGGLNAMAWYRQAPGKERELVAGIFGVGSTRYADSVKGRFTISRDNSKNTVYLQMNSLRPEDTAVYYCRMSSVTRGSSDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5666 - protein, 964 aa, Artificial Sequence
  Synthetic Polypeptide encoding a CAR with optional accessory module(s)
MALPVTALLLPLALLLHAARPDEFVDNKFNKERYSAYYEIWQLPNLNVRQKAAFIGSLQDDPSQSANLLAEAKKLNDAQAPKTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5667 - protein, 1186 aa, Artificial Sequence
  Synthetic Polypeptide encoding a CAR with optional accessory module(s)
MALPVTALLLPLALLLHAARPDEFDVQLVESGGGLVQPGGSLRLSCAASGSIGGLNAMAWYRQAPGKERELVAGIFGVGSTRYADSVKGRFTISRDNSKNTVYLQMNSLRPEDTAVYYCRMSSVTRGSSDYWGQGTLVTVSSLEGGGGSGGGGSGGGGSGSGGSGSGGSGSGGSGSGGSFEVQLVESGGSLVQPGGSLRLSCAASGFTFDDYAMSWVRQVPGKGLEWVSSINWSGTHTDYADSVKGRFTISRNNANNTLYLQMNSLKSEDTAVYYCAKNWRDAGTTWFEKSGSAGQGTQVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5668 - protein, 1144 aa, Artificial Sequence
  Synthetic Polypeptide encoding a CAR with optional accessory module(s)
MALPVTALLLPLALLLHAARPDQSVLTQPPSVSVAPGKTARIPCEGNYIGSSNVHWYQQKPGQAPVLVIHFDSDRPSGIPDRFSGSNSGNMATLTISRVEAGDEADYYCQVWENHGWVFGGGTKLTVLSGGGGSGGGGSGGGGSEVQLVETGGGLVQPGESLRLSCAASGFTFSDYEMNWVRQAPGKGLEWVSYISSSGSTIYYADSVKGRFTIYRDNAKNSLYLQMNSLRAEDTALYYCARAWGVGPPDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5669 - protein, 1152 aa, Artificial Sequence
  Synthetic Polypeptide encoding a CAR with optional accessory module(s)
MALPVTALLLPLALLLHAARPDIQMTQSPSSLSASVGDTVTITCQANGYLNWYQQRRGKAPKLLIYDGSKLERGVPSRFSGRRWGQEYNLTINNLQPEDIATYFCQVYEFVVPGTRLDLKRTVAAPGGGGSGGGGSGGGGSQVQLLQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTQVTVSSASTKGPTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5670 - protein, 1158 aa, Artificial Sequence
  Synthetic Polypeptide encoding a CAR with optional accessory module(s)
MALPVTALLLPLALLLHAARPQSALTQPPSASGSPGQSITISCTGTSNNFVSWYQQHAGKAPKLVIYDVNKRPSGVPDRFSGSKSGNTASLTVSGLQTDDEAVYYCGSLVGNWDVIFGGGTKLTVLGGGGSGGGGSGGGGSQPQLQESGPTLVEASETLSLTCAVSGDSTAACNSFWGWVRQPPGKGLEWVGSLSHCASYWNRGWTYHNPSLKSRLTLALDTPKNLVFLKLNSVTAADTATYYCARFGGEVLRYTDWPKPAWVDLWGRGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5671 - protein, 1143 aa, Artificial Sequence
  Synthetic Polypeptide encoding a CAR with optional accessory module(s)
MALPVTALLLPLALLLHAARPEIVLTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIKRGGGGSGGGGSGGGGSQVQLVQSGGQMKKPGESMRISCRASGYEFIDCTLNWIRLAPGKRPEWMGWLKPRGGAVNYARPLQGRVTMTRDVYSDTAFLELRSLTVDDTAVYFCTRGKNCDYNWDFEHWGRGTPVIVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5672 - protein, 1153 aa, Artificial Sequence
  Synthetic Polypeptide encoding a CAR with optional accessory module(s)
MALPVTALLLPLALLLHAARPELVLTQSPGTLSLSAGERATLSCRASQSVSSGSLAWYQQKPGQAPRLLIYGASTRATGIPDRFSGSGSGTDFTLTIGRLEPEDLAVYYCQQYGTSPYTFGQGTKLEIGGGGSGGGGSGGGGSLEQSGAEVKKPGSSVQVSCKASGGTFSMYGFNWVRQAPGHGLEWMGGIIPIFGTSNYAQKFRGRVTFTADQATSTAYMELTNLRSDDTAVYYCARDFGPDWEDGDSYDGSGRGFFDFWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5673 - protein, 1149 aa, Artificial Sequence
  Synthetic Polypeptide encoding a CAR with optional accessory module(s)
MALPVTALLLPLALLLHAARPDVVMTQSPSSLSASVGDRVTITCQSSLDISHYLNWYQQKPGKAPKLLIYDASNLETGVPSRFSGSGSGTHFTFTISSLQPEDFATYYCQQYDNLPLTFGGGTKLEIKRGGGGSGGGGSGGGGSQVQLVQSGGGVVQPGGSLRVSCAASGVTLSDYGMHWVRQAPGKGLEWVAFIRNDGSDKYYADSVKGRFTISRDNSEKTVSLQMSSLRAEDTAVYYCAKNGESGPLDYWYLDLWGRGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5674 - protein, 1149 aa, Artificial Sequence
  Synthetic Polypeptide encoding a CAR with optional accessory module(s)
MALPVTALLLPLALLLHAARPDDIVMTQSQDSMATSVGERVTVNCKASQNVDTNVAWYQQKPGQSPEPLLFSASYRYTGVPDRFSGSGSGTDFTLTISSVQAEDVAEYFCQQYNSYPLTFGQGTKLEIKRGGGGSGGGGSGGGGSEVQVEVSGGGLVQPGGSMRLSCAVSGFTFSNYWMNWVRQSPEKGLEWIAEIRLKSNNFARYYAESVKGRFTISRDNSKNSLYLQMISLRAEDTAIYYCTSYGNYVGHYFDHWGQGTLLTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5675 - protein, 1153 aa, Artificial Sequence
  Synthetic Polypeptide encoding a CAR with optional accessory module(s)
MALPVTALLLPLALLLHAARPSYELTQPPSVSGTPGQRVAISCSGSSSNIGTRMVTWYQHVPGTAPKLLIFNNNQRPSGVPDRFSASKSGTSASLAIIGLQSDDEADYYCATWDDNVKSYVFGTGTKVTVLGSRGGGGSGGGGSGGGGSLEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARAPQSWYVGDVWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5676 - protein, 1150 aa, Artificial Sequence
  Synthetic Polypeptide encoding a CAR with optional accessory module(s)
MALPVTALLLPLALLLHAARPQSVLTQPPSLSVAPGKTASITCGGNNIGMKSVHWYQQRPGQAPVLVIYYDSDRPSGIPGRFSGSNSGNTATLTISRVEAGDEADYYCQVWDTTGDHPGYVFGTGTKVTVLGGGGSGGGGSGGGGSQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGVYGYSGSAPYDEWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5677 - protein, 1156 aa, Artificial Sequence
  Synthetic Polypeptide encoding a CAR with optional accessory module(s)
MALPVTALLLPLALLLHAARPDEIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPRTFGQGTKVEIKRGGGGSGGGGSGGGGSQVQLVQSGGGVVQPGRSLRLSCAASGFTFSSYGMHWVRQAPGKGLEWVAVISYDGSNKYYADSVKGRFTISRDNSKNTLYLQMNSLRAEDTAVYYCARDFDYGDSYYYYGMDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5678 - protein, 1150 aa, Artificial Sequence
  Synthetic Polypeptide encoding a CAR with optional accessory module(s)
MALPVTALLLPLALLLHAARPDEIVLTQSPATLSLSPGERATLSCRASQSVGSYLAWYQQKPGAPRLLIYDASHRATGIPARFSGSGSGTDFTLTISSLEPEDFAVYYCQQRSNWPPMYTFGQGTKLEIKRGGGGSGGGGSGGGGSEVQLVQSGAEVSVKVSCKASGGKKPGSTFSSYTISWVRQAPGQGLEWMGGIIPIFGTANYAQKFQGRVTITADKSTSTAYMELSSLRSEDTAVYYCAGDTDSSGYYGAVDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5679 - protein, 1133 aa, Artificial Sequence
  Synthetic Polypeptide encoding a CAR with optional accessory module(s)
MALPVTALLLPLALLLHAARPDIQMTQSPSSLSASVGDRVTITCQASQDINNYLNWYQQKPGKAPKLLIYDASNLQTGVPSRFSGSGSGTDFTFTIEDIATYYCQQYTFGPGTKVDIKGGGGSGGGGSGGGGSEVQLLESGGGLVQPGGSLRLSCAASGFTFSWYSMTWVRQAPGKGLEWVSSIVPWGDFTQYADSVKGRFTISRDNSKNTLYLQMNSLRAEDTAVYYCAKGPGWGSFDLWGRGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5680 - protein, 1022 aa, Artificial Sequence
  Synthetic Polypeptide encoding a CAR with optional accessory module(s)
MDWIWRILFLVGAATGAHSEVQLVESGGGLVQPGGSLRLSCAASGSVFKINVMAWYRQAPGKGRELVAGIISGGSTSYADSVKGRFTISRDNAKNTLYLQMNSLRPEDTAVYYCAFITTESDYDLGRRYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5681 - protein, 1143 aa, Artificial Sequence
  Synthetic Polypeptide encoding a CAR with optional accessory module(s)
MALPVTALLLPLALLLHAARPDIQMTQSPSSLSASVGDRVTITCTASLSVSSTYLHWYQQKPGSSPKLWIYSTSNLASGVPSRFSGSGSGTSYTLTISSLQPEDFATYYCHQYHRSPLTFGGGTKVEIKRGGGGSGGGGSGGGGSEVQLVESGGGLVQPGGSLRLSCAASGFSLTKYGVHWVRQAPGKGLEWVGVKWAGGSTDYNSALMSRFTISKDNAKNSLYLQMNSLRAEDTAVYYCARDHRDAMDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5682 - protein, 1147 aa, Artificial Sequence
  Synthetic Polypeptide encoding a CAR with optional accessory module(s)
MALPVTALLLPLALLLHAARPDIQMTQSPSSLSASVGDRVTITCKASQDVGTAVAWYQQKPGKAPKLLIYSASYRSTGVPSRFSGSGSGTDFTLTISSLQPEDFATYYCQHHYSAPWTFGGGTKVEIKGGGGSGGGGSGGGGSEVQLVESGGGLVQPGGSLRLSCAASGFTFSRNGMSWVRQAPGKGLEWVATVSSGGSYIYYADSVKGRFTISRDNAKNSLYLQMNSLRAEDTAVYYCARQGTTALATRFFDVWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5683 - protein, 1153 aa, Artificial Sequence
  Synthetic Polypeptide encoding a CAR with optional accessory module(s)
MALPVTALLLPLALLLHAARPDIVMTQSPSSLTMSVGQKVTMSCKSSHSLLNSRNQKNYLAWFQQKPGQSPKLLVYFASTRESGVPDRFIGSGSGTDFTLTISNVQAEDLADYFCQQHYTTLPTFGGGTKLEIKGGGGSGGGGSGGGGSQIQLVQSGPDLKKPGETVKISCKASGYTFTNTGMNWVKQAPGKGLKWMGWINTYTGEPTYADDFKGRFTFSLETSASTAYLQINNLKNEDTATYFCTRWGYGSSLYYAMDYWGQGTSVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5684 - protein, 1143 aa, Artificial Sequence
  Synthetic Polypeptide encoding a CAR with optional accessory module(s)
MALPVTALLLPLALLLHAARPDIQMTQSPPSLSASVGGKVTITCKASQDIDRYMAWYQDKPGKGPKLLIHDTSTLQPGIPSRFSGSGSGRDYSFSISNLEPEDIATYYCLQYDNLWTFGGGTKLEIKRGGGGSGGGGSGGGGSQVQLVQSGAELVKPGASVKMSCKASGYIFTNYNIHWVKKSPGQGLEWIGAIYPGNGDAPYSQKFQDRATLTADTSSSTTYMELSSLTSEDSAVYYCVRANWDVAFAYWGQGTLVSVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5685 - protein, 1144 aa, Artificial Sequence
  Synthetic Polypeptide encoding a CAR with optional accessory module(s)
MALPVTALLLPLALLLHAARPDIQMTQSPASLSASVGETVTITCRVSGNIHNYLAWYQQKQGKSPQLLVYNAKTLADGVPSRFSGSGSGTQYSLKINSLQPEDFGSYYCQHFWSNPYTFGGGTKLEIKGGGGSGGGGSGGGGSQVQLQQSGASVKVSCKASELVRPGTGYAFTNYLIEWVKQRPGQGLEWIGVINPGSGGTNYNEKFKGKATLTADKSSSTAYMQLSSLTSDDSAVYFCARYRSYDWYFDVWGAGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5686 - protein, 1149 aa, Artificial Sequence
  Synthetic Polypeptide encoding a CAR with optional accessory module(s)
MALPVTALLLPLALLLHAARPDDIQMTQSPSSLSASVGDRVTITCRSSQRIVHSNGNTYLEWYQQTPGKAPKLLIYKVSNRFSGVPSRFSGSGSGTDYTPTISSLQPEDIATYYCFQGSHVPPTFGQGTKLQITGGGGSGGGGSGGGGSEVQLVESGGGVVQPGRSLRLSCSSSGPTFSDYYMYWVRQAPGKGLEWVAYMSNVGAITDYPDTVKGRPTISRDNSKNTLFLMDSLRPEDTGVYFCARGTRDGSWFAYWGQGTPVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5687 - protein, 1143 aa, Artificial Sequence
  Synthetic Polypeptide encoding a CAR with optional accessory module(s)
MALPVTALLLPLALLLHAARPDIQMTQSFSSLSASVGDRVTITCRASQDISNYLNWYQQKPGKAPKLLIYYTSRLHSGVPSRFSGSGSGTDYTLTISSLQPEDFATYFCQQGNTLPWTFGGGTKLEIKRGGGGSGGGGSGGGGSEVQLVQSGGGLVQSGGSLRLSCRASGYTFTRYWMLWVRQRPGKGLEWVAEINPRNDRTNYNEKFKTRFTISVDRSKNTLYLQMDSLRAEDTAVYFCALGGGYAMDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5688 - protein, 1130 aa, Artificial Sequence
  Synthetic Polypeptide encoding a CAR with optional accessory module(s)
MEMLQGLLLLLLLSMGGAWASREPLRPWCHPINAILAVEKEGCPVCITVNTTICAGYCPTMMRVLQAVLPPLPQVVCTYRDVRFESIRLPGCPRGVDPVVSFPVALSCRCGPCRRSTSDCGGPKDHPLTCDHPQLSGLLFLGGGGSGGGGSGGGGSAPDVQDCPECTLQENPFFSQPGAPILQCMGCCFSRAYPTPLRSKKTMLVQKNVTSESTCCVAKSYNRVTVMGGFKVENHTACHCSTCYYHKSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5689 - protein, 1144 aa, Artificial Sequence
  Synthetic Polypeptide encoding a CAR with optional accessory module(s)
MALPVTALLLPLALLLHAARPDIQMTQSPASLSASVGETVTIICRASVNIYSYLAWYQQKQGKSPQLLVYNAKILAEGVPSRFSGSGSGTQFSLKINSLQPEDFGSYYCQHHYGTFTFGSGTKLEIKRGGGGSGGGGSGGGGSQVQLKESGPGLVAPSQSLSITCTISGFSLTSYGVHWVRQPPGKGLEWLVVIWSDGSTTYNSALKSRLSISKDNSKSQVFLKMNSLQTDDTAIYYCASHYGSTLAFASWGHGTLVTVSAATREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5690 - protein, 1152 aa, Artificial Sequence
  Synthetic Polypeptide encoding a CAR with optional accessory module(s)
MALPVTALLLPLALLLHAARPDIVMTQSHKFMSTSVGDRVSVTCKASQNVGNNVAWYQQKPGQSPKVLIYSASYRYSGVPDRFTGSGSGTDFTLTISNVQSEDLAEYFCQQYNTYPFTFGSGTKLEIKGGGGSGGGGSGGGGSEVQLEESGGGLVQPGGSMKLSCVASGFTFSNYWMNWVRQSPEKGLEWVAEIRFKSHNYATHFAESVKGRFTISRDDSKSSVYLQMNNLRAEDTGIYYCTRRIGNSDYDWWYFDVWGAGTSVTVSSASTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5691 - protein, 1148 aa, Artificial Sequence; identical to SEQ ID NO: 5576
  Synthetic Polypeptide encoding a CAR with optional accessory module(s)

SEQ ID NO: 5692 - protein, 1154 aa, Artificial Sequence
  Synthetic Polypeptide encoding a CAR with optional accessory module(s)
MALPVTALLLPLALLLHAARPDQSVLTQPPSVSGAPGQRVTISCTGSSSNIGAGYDVHWYQQLPGTAPKLLIYGNSNRPSGVPDRFSGSKSGTSASLAITGLQAEDEADYYCQSYDNSLSSWVFGGGTKLTVLGQPKGGGGSGGGGSGGGGSEVQLQQSGAEVKKPGSSVKVSCKASGGTFSSYAISWVRQAPGQGLEWMGRIIPILGIANYAQKFQGRVTITADKSTSTAYMELSSLRSEDTAVYYCARDVGSGSYSLDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5693 - protein, 1151 aa, Artificial Sequence
  Synthetic Polypeptide encoding a CAR with optional accessory module(s)
MALPVTALLLPLALLLHAARPDQSVVTQPPSVSAAPGRKVTISCSGSSSNIGSNYVSWYQQVPGTAPKLLIYEDDKRPSGIPDRFSGSKSGTSATLGITGLQTGDEADYFCATWDRTVNVVRFGGGTRLTVHSQPKGGGGSGGGGSGGGGSQLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARHVGHELDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5694 - protein, 1145 aa, Artificial Sequence
  Synthetic Polypeptide encoding a CAR with optional accessory module(s)
MALPVTALLLPLALLLHAARPDIQMTQSPSSLSASVGDRVTITCRASQSISSYLNWYQQKPGKAPKLLIYAASSLQSGVPSGFSGSGSGTDFTLTISSLQPEDFATYYCQQSYSTPLTFGGGTKVEIKRGGGGSGGGGSGGGGSQVQLQESGPGLVKPSETLSLTCTVSGGSVSSGSYYWSWIRQPPGKGLEWIGYIYYSGSTNYNPSLKSRVTISVDTSKNQFSLKLSSVTAADTAVYYCAREGKNGAFDIWGQGTMVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5695 - protein, 1031 aa, Artificial Sequence
  Synthetic Polypeptide encoding a CAR with optional accessory module(s)
MALPVTALLLPLALLLHAARPDEFDVQLVESGGGLVQPGGSLRLSCAASGFILDYYAIGWFRQAPGKEREGVLCIDASDDITYYADSVKGRFTISRDNSKNTVYLQMNSLRPEDTAVYYCATPIGLSSSCLLEYDYDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5696 - protein, 1194 aa, Artificial Sequence
  Synthetic Polypeptide encoding a CAR with optional accessory module(s)
MALPVTALLLPLALLLHAARPDEFDVQLVESGGGLVQPGGSLRLSCAASGFILDYYAIGWFRQAPGKEREGVLCIDASDDITYYADSVKGRFTISRDNSKNTVYLQMNSLRPEDTAVYYCATPIGLSSSCLLEYDYDYWGQGTLVTVSSLEGGSGSGGGGSGGGGSGSGGSGSGGSGSGGSGSGGSFEVQLVESGGGLVQPGGSLRLSCAASGRTYYLNAMGWFRQAPGKEREFVAAIDWSEGNKDYADSVKGRFTISRDNSKNTVYLQMNSLRPEDTAVYYCAADTPPWGPLIYIESYDSWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5697 - protein, 1145 aa, Artificial Sequence
  Synthetic Polypeptide encoding a CAR with optional accessory module(s)
MALPVTALLLPLALLLHAARPDQIVLTQSPAIMSASPGEKVTISCSASSSVSYMYWYQQKPGSSPKPWIYRTSNLASGVPARFSGSGSGTSYSLTISNMEAEDAAAYYCQQYHSYPTTFGGGTKLEVKGGGGSGGGGSGGGGSEVQLVESGGGLVQPKGSLKLSCAASGFSFNTYAMNWVRQAPGKGLEWIAHIRSKSNNFATYYADSVKDRFSISRDASENILFLQMNNLKTEDTAMYYCVRQGGDFPMDYWGQGTSVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5698 - protein, 1144 aa, Artificial Sequence
  Synthetic Polypeptide encoding a CAR with optional accessory module(s)
MALPVTALLLPLALLLHAARPDDIQMTQSSSSFSVSLGDRVTITCMASEDIYIRLAWYQQKPGNAPRLLISAATSLETGVPSRFSGSGSGKDYTLSITSLQTEDVGTYYCQQYWSSPWTFGGGTKLEINGGGGSGGGGSGGGGSDVQLQESGPGLVKPSQSLSLTCTVTGYSITSDYTWNWIRQFPGNKLEWMGYITYSGSTSYNPSLKSRNSITRDTSKNQFFLQLNSVTTEDTATYYCARLGRRYTMDYWGQGTSVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5699 - protein, 1143 aa, Artificial Sequence
  Synthetic Polypeptide encoding a CAR with optional accessory module(s)
MALPVTALLLPLALLLHAARPDVQLQESGPGLVKPSQSLSLTCTVTGYSITSDYTWNWIRQFPGNKLEWMGYITYSGSTSYNPSLKSRNSITRDTSKNQFFLQLNSVTTEDTATYYCARLGRRYTMDYWGQGTSVTVSSGGGGSGGGGSGGGGSDIQMTQSSSSFSVSLGDRVTITCMASEDIYIRLAWYQQKPGNAPRLLISAATSLETGVPSRFSGSGSGKDYTLSITSLQTEDVGTYYCQQYWSSPWTFGGGTKLEINTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5700 - protein, 1144 aa, Artificial Sequence
  Synthetic Polypeptide encoding a CAR with optional accessory module(s)
MALPVTALLLPLALLLHAARPDIQMTQSSSSFSVSLGDRVTITCKASEDIYIRLAWYQQKPGNAPRLLISAATSLETGIPSRFSGSGSGEDYTLTITSLQTEDVATYYCQQYWTTPWTFGGGTKLEIKRGGGGSGGGGSGGGGSDVQLQESGPGLVKPSQSLSLTCTVTGYSITIDYTWNWIRQFPGNKLEWMGYITYSGSTDYNPSLKSRSSITRDTSMNQFFLQLNSVTTEDTATYYCARLGRRYALDYWGQGTSVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5701 - protein, 1145 aa, Artificial Sequence
  Synthetic Polypeptide encoding a CAR with optional accessory module(s)
MALPVTALLLPLALLLHAARPDIVMTQAAPSIPVTPGESVSISCRSDKSLLHSNGNTYLFWFLQRPGQSPQLLIYRMSNLASGVPDRFSGSGSGTAFTLRISGVEAEDVGVYYCMQHLEYPYTFGGGTKLEIKGGGGSGGGGSGGGGSQVQLQQSGPELVKPGASVKMSCKASGYAFSSSWLNWVRQRPGKGLEWIGRIYPGDGENHYNGKFKGKATLTADKSSSTGYMQLSSLTSEDSAVYFCASYYEGGYWGQGTLITVSATREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5702 - protein, 1144 aa, Artificial Sequence
  Synthetic Polypeptide encoding a CAR with optional accessory module(s)
MALPVTALLLPLALLLHAARPDIVLTQSPASLAVSLGQSVTISCRASESVEYYGTSLMQWYQQKPGQPPKLLIYGASNVESGVPARFSGSGSGTDFSLNIHPVEEDDIAMYFCQQSRKVPWTFGGGTKLEIKGGGGSGGGGSGGGGSEVKLVESGGGLVKPGGSRKLSCAASGFTFSSYTMSWVRQTPAKRLEWVATISSGSSTIYYADTVKGRFTISRDNAKNTLFLQMTSLRSEDTAMYYCARRWFLDCWGQGTTLTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5703 - protein, 1147 aa, Artificial Sequence
  Synthetic Polypeptide encoding a CAR with optional accessory module(s)
MALPVTALLLPLALLLHAARPDQVQLQQSGPGLVKPSETLSLTCTVSGDSISSYYWSWIRQPPGKGLEWIGYIYYSGSTNYNPSLKSRVTISVDTSKSQFSLKLSSVTAADTAVYYCARGRYFDVWGRGTMVTSSGGGGSGGGGSGGGGSSSYVLTQPPSVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLGAAATREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5704 - protein, 1148 aa, Artificial Sequence
  Synthetic Polypeptide encoding a CAR with optional accessory module(s)
MALPVTALLLPLALLLHAARPDIVMTQSPLSLPVTPGEPASISCRSSKSLLHSNGNTYLYWFQQKPGQAPRLLIYRMSNLASGVPDRFSGSGSGTAFTLKISRVEAEDVGVYYCMQHIEYPFTFGQGTKLEIKGGGGSGGGGSGGGGSQVQLVQSGPEVKKPGASVKVSCKASGYTFTNSWMNWVRQRPGKGLEWIGRIYPGDGETIYNGKFRVRVTITADESTSTAYMELSSLRSEDTAVYYCARGYDDYSFAYWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5705 - protein, 1148 aa, Artificial Sequence
  Synthetic Polypeptide encoding a CAR with optional accessory module(s)
MALPVTALLLPLALLLHAARPDEIVMTQSPATLSLSPGERATLSCRASQSVSSYLAWYQQKPGQAPRLLIYDASNRATGIPARFSGSGSGTDFTLTISSLEPEDFAVYYCHQYGSSPQTFGQGTKVEIKRGGGGSGGGGSGGGGSEVQLVQSGAEVKKPGSSVKVSCKASGGTFSSYAISWVRQAPGQGLEWMGGIIPIFGTANYAQKFQGRVTITADESTSTAYMELSSLRSEDTAVYYCAVHYGDYVFSSMDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5706 - protein, 1151 aa, Artificial Sequence
  Synthetic Polypeptide encoding a CAR with optional accessory module(s)
MALPVTALLLPLALLLHAARPDETTLTQSPGTLSLSPGERATLSCRASQSVSSSYLAWYQQKPGQAPRLLIYGASSRATGIPDRFSGSGSGTDFTLTISRLEPEDFAVYYCQQYGSSPRTFGQGTKVEIKRGGGGSGGGGSGGGGSEVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGPEYCINGVCSLDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5707 - protein, 1153 aa, Artificial Sequence
  Synthetic Polypeptide encoding a CAR with optional accessory module(s)
MALPVTALLLPLALLLHAARPDIELTQSPSSLAVSAGEKVTMSCKSSQSLLNSRTRKNQLAWYQQKPGQSPELLIYWASTRQSGVPDRFTGSGSGTDFTLTISSVQAEDLAVYYCQQSYNLLTFGPGTKLEVKRGGGGSGGGGSGGGGSVKLQESGGGFVKPGGSLKVSCAASGFTFSSYAMSWVRLSPEMRLEWVATISSAGGYIFYSDSVQGRFTISRDNAKNTLHLQMGSLRSGDTAMYYCARQGFGNYGDYYAMDYWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5708 - protein, 1152 aa, Artificial Sequence
  Synthetic Polypeptide encoding a CAR with optional accessory module(s)
MALPVTALLLPLALLLHAARPDIQMTQSPSSLSASVGDRVTITCRSSQNIVHSNGNTYLDWYQQTPGKAPKLLIYKVSNRFSGVPSRFSGSGSGTDFTFTISSLQPEDIATYYCFQYSHVPWTFGQGTKLQIGGGGSGGGGSGGGGSQVQLQQSGAEVKKPGSSVKVSCKASGYTFTNYYIYWVRQAPGQGLEWIGGINPTSGGSNFNEKFKTRVTITADESSTTAYMELSSLRSEDTAFYFCTRQGLWFDSDGRGFDFWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5709 - protein, 1048 aa, Artificial Sequence
  Synthetic Polypeptide encoding a CAR with optional accessory module(s)
MALPVTALLLPLALLLHAARPLFNQEVQIPLTESYCGPCPKNWICYKNNCYQFFDESKNWYESQASCMSQNASLLKVYSKEDQDLLKLVKSYHWMGLVHIPTNGSWQWEDGSILSPNLLTIIEMQKGDCALYASSFKGYIENCSTPNTYICMQRTVGGGGSGGGGDTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5710 - protein, 1142 aa, Artificial Sequence
  Synthetic Polypeptide encoding a CAR with optional accessory module(s)
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIKRGGGGSGGGGSGGGGSQVHLQESGPGLVKPSETLSLTCTVSDDSISSYYWSWIRQPPGKGLEWIGHISYSGSANYNPSLKSRVTISVDTSKNQFSLKLSSVTAADTAVYYCANWDDAFNIWGQGTMVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5711 - protein, 1144 aa, Artificial Sequence
  Synthetic Polypeptide encoding a CAR with optional accessory module(s)
MALPVTALLLPLALLLHAARPDVVMTQTPLTLSVTIGQPASISCKSSQSLLDSDGKTYLHWLLQRPGQSPKRLIFLVSKLDSGVPDRFTGSGSGTDFTLKISRVEAEDLGVYYCWQGTHFPQTFGGGTKLEIKGGGGSGGGGSGGGGSVQLQESGPDLVKPSQSLSLTCTVTGYSITSGYSWHWIRQFPGNKLEWMGYIHYSGDTDYNPSLKSRFSITRDTSKNQFFLQLNSVTTEDTATYYCATPGGFVYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5712 - protein, 1148 aa, Artificial Sequence
  Synthetic Polypeptide encoding a CAR with optional accessory module(s)
MALPVTALLLPLALLLHAARPDQSELTQPRSVSGSPGQSVTISCTGTERDVGGYNYVSWYQQHPGKAPKLIIHDVIERSSGVPDRFSGSKSGNTASLTISGLQAEDEADYYCWSFAGGYYVFGTGTDVTVLGGGGSGGGGSGGGGSFEVQLLESGGGLVQPGGSLRLSCAASGFTFSTYQMSWVRQAPGKGLEWVSGIVSSGGSTAYADSVKGRFTISRDNSKNTLYLQMNSLRAEDTAVYYCAGELLPYYGMDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5713 - protein, 1147 aa, Artificial Sequence
  Synthetic Polypeptide encoding a CAR with optional accessory module(s)
MALPVTALLLPLALLLHAARPDQSELTQPRSVSGSPGQSVTISCTGTERDVGGYNYVSWYQQHPGKAPKLIIHDVIERSSGVPDRFSGSKSGNTASLTISGLQAEDEADYYCWSFAGGYYVFGTGTDVTVLGGGGSGGGGSGGGGSEVQLLESGGGLVQPGGSLRLSCAASGFTFSTYEMHWVRQAPGKGLEWVSVILSSGGETNYADSVKGRFTISRDNSKNTLYLQMNSLRAEDTAVYYCAGMLLPYYGMDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5714 - protein, 1049 aa, Artificial Sequence
  Synthetic Polypeptide encoding a CAR with optional accessory module(s)
MALPVTALLLPLALLLHAARPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5715 - protein, 1144 aa, Artificial Sequence
  Synthetic Polypeptide encoding a CAR with optional accessory module(s)
MALPVTALLLPLALLLHAARPDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRGGGGSGGGGSGGGGSEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5716 - protein, 1145 aa, Artificial Sequence
  Synthetic Polypeptide encoding a CAR with optional accessory module(s)
MALPVTALLLPLALLLHAARPAIVMTQTPSPVSAAVGGTVTINCQASESVYSNNYLSWFQQKPGQPPKLLIYLASTLASGVPSRFKGSGSGTQFTLTISGVQCDDAATYYCIGGKSSSTDGNAFGGGTEVVVRGGGGSGGGGSGGGGSQSLEESGGRLVKPDETLTITCTVSGIDLSSNGLTWVRQAPGEGLEWIGTINKDASAYYASWAKGRLTISKPSSTKVDLKITSPTTEDTATYFCGRIAFKTGTSIWGPGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5717 - protein, 1143 aa, Artificial Sequence
  Synthetic Polypeptide encoding a CAR with optional accessory module(s)
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKGGGGSGGGGSGGGGSQVQLVQSGAEVKKPGASVKVSCKASGYTFTSYDVHWVRQAPGQRLEWMGWLHADTGITKFSQKFQGRVTITRDTSASTAYMELSSLRSEDTAVYYCARERIQLWFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5718 - protein, 1162 aa, Artificial Sequence
  Synthetic Polypeptide encoding a CAR with optional accessory module(s)
MALPVTALLLPLALLLHAARPDDIVMTQSPLSLPVTPGEPASISCRSSQSLLHSNGYNYLVWYLQKPGQSPQLLIYLGSIRASGVPDRFSGSGSGTDFTLKISRVEAEDVGVYYCMQPLQTPITFGQGTRLEIKRGGGGSGGGGSGGGGSGLQCVAAPRWVLSQVQLQQWGAGLLKPSETLSLTCAVYGGSFSGNYWSWIRQPPGKGLEWIGEINHSGSTNYNPSLKSRVTISVDTSKNQFSLKLSSVTAADTAVYYCARGGSYNYFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5719 - protein, 1159 aa, Artificial Sequence
  Synthetic Polypeptide encoding a CAR with optional accessory module(s)
MALPVTALLLPLALLLHAARPDQLTQSPSSVSASVGDRVTITCRASRGISSWLAWYQQKPGKAPKLLIYTASSLQSGVPSRFSGSGSGTDFTLTISSLQPEDFATYYCQQAYSFPRTFGQGTKVEIKRGGGGSGGGGSGGGGSVAAPRWVLSQVQLQESGPGLVKPSQTLSLTCTVSGGSISSGGYYWIWIRQHPGKGLEWIGYIYYNGNTYYNPSLKSRVTMSVDTSKNQFSLKLSSVTAADTAVYYCARDGITMIRGYYYGMDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5720 - protein, 1133 aa, Artificial Sequence
  Synthetic Polypeptide encoding a CAR with optional accessory module(s)
MALPVTALLLPLALLLHAARPDIVVTQSPASLAVSLGQRATISYRASKSVSTSGYSYMHWNQQKPGQPPRLLIYLVSNLESGVPARFSGSGSGTDFTLNIHPVEEEDAATYYCQHIRELTRSEGGPSWKGGGGSGGGGSGGGGSEVKLEESGGDLVKPGGSLKLSCAASGFTFSGYGMSWVRQTPDKRLEWVATISSGGSYTYYPDSVKGRFTISRDNAKNTLYLQMSSLKSEDTAMYYCARHEGGYYGSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5721 - protein, 1149 aa, Artificial Sequence
  Synthetic Polypeptide encoding a CAR with optional accessory module(s)
MALPVTALLLPLALLLHAARPDDIQMTQSPSSLSASVGDRVTITCRASQGISNYLAWYQQKTGKVPKFLIYEASTLQSGVPSRFSGGGSGTDFTLTISSLQPEDVATYYCQNYNSAPFTFGPGTKVDIKGGGGSGGGGSGGGGSQVQLVESGGGVVQPGRSLRLSCAASGFAFSRYGMHWVRQAPGKGLEWVAVIWYDGSNKYYADSVKGRFTISRDNSKNTQYLQMNSLRAEDTAVYYCARGGDFLYYYYYGMDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5722 - protein, 1140 aa, Artificial Sequence
  Synthetic Polypeptide encoding a CAR with optional accessory module(s)
MALPVTALLLPLALLLHAARPDIQMTQSPSSLSTSVGDRVTLTCKASQDVGTAVDWYQQKPGPSPKLLIYWASTRHTGIPSRFSGSGSGTDFTLTISSLQPEDFADYYCQQYNSYPLTFGPGTKVDIKGGGGSGGGGSGGGGSEVQLVQSGPEVKKPGATVKISCKTSGYTFTEYTIHWVKQAPGKGLEWIGNINPNNGGTTYNQKFEDKATLTVDKSTDTAYMELSSLRSEDTAVYYCAAGWNFDYWGQGTLLTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5723 - protein, 1141 aa, Artificial Sequence
  Synthetic Polypeptide encoding a CAR with optional accessory module(s)
MALPVTALLLPLALLLHAARPDIQMTQSPSSLSASVGDRVTITCKASQDIYPYLNWFQQKPGKAPKTLIYRTNRLLDGVPSRFSGSGSGTDFTFTISSLQPYYCLQYDEFPLTFGAGTKLEIKRGGGGSGGGGSGGGGSQITLKESGPTLVKPTQTLTLTCTFSGFSLSTSNMGVGWIRQPPGKALEWLAHIWWDDDKYYSPSLKSRLTITKDTSKNQVVLTMTNMDPVDTATYYCVRSNYGYAWFAYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5724 - protein, 1141 aa, Artificial Sequence
  Synthetic Polypeptide encoding a CAR with optional accessory module(s)
MALPVTALLLPLALLLHAARPDIVMTQSQKFMSTSVGDRVNVTCKASQNVGTNVVWYQQKTGQSPKALIHSASYRYSGVPDRFTGSGSGTDFTLTLSNVQSEDLAEYFCQHYNSFPYTFGGGTKLEIKRGGGGSGGGGSGGGGSQVQLQQSGAELVRPGVSVKISCKGSGYRFTDYPIHWVKQSHAKSLEWIGIISTYYGDVTNNPKFRGKATMTVDKSSTTAYMELARLTSEDSAIYYCARNDLFAYWGQGTLVTVSATREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5725 - protein, 1144 aa, Artificial Sequence
  Synthetic Polypeptide encoding a CAR with optional accessory module(s)
MALPVTALLLPLALLLHAARPDIKMTQSPSSMYASLGERVTITCKASPDINSYLSWFQQKPGKSPKTLIYRANRLVDGVPSRFSGGGSGQDYSLTINSLEYEDMGIYYCLQYDEFPYTFGGGTKLEMKGGGGSGGGGSGGGGSEVKLVESGGGLVKPGGSLKLSCAASGFTFSSYAMSWVRQIPEKRLEWVASISRGGTTYYPDSVKGRFTISRDNVRNILYLQMSSLRSEDTAMYYCGRYDYDGYYAMDYWGQGTSVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5726 - protein, 1147 aa, Artificial Sequence
  Synthetic Polypeptide encoding a CAR with optional accessory module(s)
MALPVTALLLPLALLLHAARPDDVVVTPVSCFLSCISGAEGHHLIQGQQKCQYIWLLYALEPTETRTATQTPHLSCIQPRIWGPCQVQWQWVWDRLHPQHPSCGGGGCCNLLLSAHGAYTFGGGTRLELKGGGGSGGGGSGGGGSEVKLQESGPELVKPGASVKMSCKASGYTFTSYVMHWVKQKPGQGLEWIGYINPYNDGTKYNEKFKGKATLTSDKSSSTAYMELSSLTSEDSAVYYCARWKIYYGNYEDYWGQGTPLTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5727 - protein, 1177 aa, Artificial Sequence
  Synthetic Polypeptide encoding a CAR with optional accessory module(s)
MALPVTALLLPLALLLHAARPDEFQVQLVQSGGGLVQPGGSLRLSCAASDFDFAAYEMSWVRQAPGQGLEWVAIISHDGIDKYYTDSVKGRFTISRDNSKNTLYLQMNTLRAEDTATYYCLRLGAVGQGTLVTVSSLEGGGGSGGGGSGGGGSGSGGSGSGGSGSGGSGSGGSFEQVQLVQSGGGLVQPGGSLRLSCAASDFAFDDYEMSWVRQAPGKALEWIGDINHSGTTIYNPSLKSRVTISRDNSKNTLYLQMNTLRAEDTAIYYCARPHYGDYSDAFDIWGQGTMVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5728 - protein, 1152 aa, Artificial Sequence
  Synthetic Polypeptide encoding a CAR with optional accessory module(s)
MALPVTALLLPLALLLHAARPEIVMTQSPATLSVSPGERATLSCRASQSVSSNLAWYQQKPGQAPRLLIYGASTRATGIPARFSGSGSGTDFTLTISSLQSVDSAVYYCQQYNNWPPYTFGQGTKLEIKGGGGSGGGGSGGGGSQVQLLESGGGVVQPGRSLRLSCAASGFTFSFYGMHWVRQAPGKGLEWVAAISYDGSNKYYADSVKGRFTISRDNSKNTLYLQMNSLRAEDTAVYYCAKRPNQFYCSDGRCYSIDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5729 - protein, 1148 aa, Artificial Sequence
  Synthetic Polypeptide encoding a CAR with optional accessory module(s)
MALPVTALLLPLALLLHAARPQSVLTQPPSASAGGTPGQRVTISCSGSSSNIGSNFVYWYQQLPGTAPKLLIYRNNQRPSGVPDRFSGSRSGTSASLAGLRSEDEADYYCAADSLGGHYVFGTGTKVLGGGGSGGGGSGGGGSQVQLVESGGGSVQPGRSLRLSCEASGFTFEAYAMHWVRQPPGKGLEWVSSINWNSGRIAYADSVKGRFTISRDNARNSLYLQMNSLRLEDTAFYYCAKDIRRFSTGGAEFEYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5730 - protein, 1143 aa, Artificial Sequence
  Synthetic Polypeptide encoding a CAR with optional accessory module(s)
MALPVTALLLPLALLLHAARPENVLTQSPAIMSASPGEKVTMTCSASSSVSYMHWYQQKSSTSPKLWIYDTSKLASGVPGRFSGSGSGNSYSLTISSMEAEDVATYYCFQGSGYPLTFGAGTKLELKGGGGSGGGGSGGGGSQVQLKESGPGLVAPSQSLSITCTVSGFSLSSQGVYWVRQPPGKGLEWLGAIWAGGSTNYNSALMSRLSISKDNSKSQVFLKMNSLQTDDTAMYYCARVDGYRGYNMDYWGQGTSVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5731 - protein, 1147 aa, Artificial Sequence
  Synthetic Polypeptide encoding a CAR with optional accessory module(s)
MALPVTALLLPLALLLHAARPDDIQMTQSPSSLSASVGDRVTITCRASQSISSYLNWYQQKPGKAPKLLIYDASNLETGVPSRFSGSGSGTDFTFTISSLQPEDIATYYCQQYDNLPLTFGGGTKVDIKRGGGGSGGGGSGGGGSQVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARAHNSSSWSFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5732 - protein, 1156 aa, Artificial Sequence
  Synthetic Polypeptide encoding a CAR with optional accessory module(s)
MALPVTALLLPLALLLHAARPDDVVMTQSPLSLPVSLGDQASISCRSSQRLVHSNGNTYLHWYLQKPGQSPKLLIYRVSNRFPGVPDRFSGSGSGTDFTLKISRVEAEDLGIYFCSQSTHVPYTFGGGTKLEIKRGGGGSGGGGSGGGGSEVRLQQSGPDLIKPGASVKMSCKASGYTFTGYVMHWVKQRPGQGLEWIGFINPYNDDIQSNERFRGKATLTSDKSSTTAYMELSSLTSEDSAVYYCARGAGYNFDGAYRFFDFWGQGTTLTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5733 - protein, 1147 aa, Artificial Sequence
  Synthetic Polypeptide encoding a CAR with optional accessory module(s)
MALPVTALLLPLALLLHAARPDSYELTQPPSVSVSPGQTATISCSGDQLGGKYGHWYQKKPGQSPVLVLYQDRKRPAGIPERFSGSSSGNTITLTISGTQAVDEADYYCQAWDTNLGGVFGGGTKVTVLGQGGGGSGGGGSGGGGSQVQLVESGAEVKKPGASVKVSCKASGYTFTGYYMHWVRQAPGQGLEWMGRINPNSGGTNYAQKFQGRVTMTRDTSISTAYMELSRLRSDDTAVYYCASPRGRGSAFDIWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5734 - protein, 1150 aa, Artificial Sequence
  Synthetic Polypeptide encoding a CAR with optional accessory module(s)
MALPVTALLLPLALLLHAARPDNFMLTQPHSVSESPGKTVTISCTRSSGSIASKYVQWYQQRPGSSPTTVIYEDNQRPSGVPDRFSGSIDTSSNSASLTISGLRTEDEADYYCHSYDSNNHSVFGGGTKVTVLGQGGGGSGGGGSGGGGSEVQLVESGGGVVQPGGSLRLSCAASGFTFSSYAMSWVRQAPGKGLEWVSAISGSGGSTYYADSVKGRFSISRDNSKNTLYLQMNSLRAEDTAVYYCARTRSSGAFDIWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5735 - protein, 1145 aa, Artificial Sequence
  Synthetic Polypeptide encoding a CAR with optional accessory module(s)
MALPVTALLLPLALLLHAARPDIQMNQSPSSLSASLGDTITITCHASQNINVWLSWYQQKPGNIPKLLIYKASNLHTGVPSRFSGSGSGTGFTITISSLQPEDIATYYCQQGQSYPWTFGGGTKLEIKRGGGGSGGGGSGGGGSEVQLQQSGPELVKPGASVKISCKASGYSFTGYFMNWVKQSHGKSLEYIGRFNPYNGETLYNQKFKGKATLTVDKSSSTVHMELLSVTSEDSAVYYCGRSGNDDAMDYWGQGTSVTVSSATREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5736 - protein, 1146 aa, Artificial Sequence
  Synthetic Polypeptide encoding a CAR with optional accessory module(s)
MALPVTALLLPLALLLHAARPDDIQMTQSPSILSASVGDRVTITCRASQRFGDYLAWYQQKPGQAPKLLIYGASTLQSGVPSRFSGSGSGTEFTLTISGLQPEDFATYYCQQANSFPITFGKGTRLDIRRGGGGSGGGGSGGGGSQVQLVQSGAEVKKPGSSVKVSCKASGGTFSSYAISWVRQAPGQGLEWMGWINVGNGNAIYSQKFQGRVTITRDTSATTAYMELSSLRSEDTAVYYCARDGERAWDLDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5737 - protein, 1151 aa, Artificial Sequence
  Synthetic Polypeptide encoding a CAR with optional accessory module(s)
MALPVTALLLPLALLLHAARPDETTLTQSPGTLSLSPGERATLSCRASQSVSSSYLAWYQQKPGQAPRLLIYGASSRATGIPDRFSGSGSGTDFTLTISRLEPEDFAVYYCQQYGSSPYTFGQGTKLEIKRGGGGSGGGGSGGGGSQVQLVQSGGGVVQPGRSLRLSCAASGFTFSSYAMHWVRQAPGKGLEWVAVISYDGSNKYYADSVKGRFTISRDNSKNTLYLQMNSLRAEDTAVYYCARELRFLEWSSDAFDIWGQGTMVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5738 - protein, 1146 aa, Artificial Sequence
  Synthetic Polypeptide encoding a CAR with optional accessory module(s)
MALPVTALLLPLALLLHAARPEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKGGGGSGGGGSGGGGSQLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPTMIRGVIDSWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5739 - protein, 1143 aa, Artificial Sequence
  Synthetic Polypeptide encoding a CAR with optional accessory module(s)
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKGGGGSGGGGSGGGGSQVQLVQSGAEVRKPGSSVKVSCKASGGSFNNYPIFWVRQAPGQGFEWMGRIIPILGITAYAQKFQGRVTITADKSTSTAYMELNSLRSEDTAVYYCAGGDDLDAFDIWGQGTMVSVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5740 - protein, 1155 aa, Artificial Sequence
  Synthetic Polypeptide encoding a CAR with optional accessory module(s)
MALPVTALLLPLALLLHAARPDIVMTQTPLSLPVTPGEPASISCRSSRSLLDSDDGNTYLDWYLQKPGQSPQLLIYTLSYRASGVPDRFSGSGSGTDFTLKISRVEAEDVGVYYCMQRVEFPITFGQGTRLEIKRGGGGSGGGGSGGGGSQVQLVESGGGVVQPGRSLRLSCAASGFIFSRYGMHWVRQAPGKGLKWVAVIWYDGSNKLYADSVKGRFTISRDNSKNTLYLQMNSLRAEDTAVYYCARDYYDNSRHHWGFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5741 - protein, 1145 aa, Artificial Sequence
  Synthetic Polypeptide encoding a CAR with optional accessory module(s)
MALPVTALLLPLALLLHAARPEIQMTQSPSSMSASLGDTITITCQATQDIFKNLNWYQQKPGKPPSLLIYYATELAEGVPSRFSGSGSGSDYSLTISNLESEDFAAYYCLQFFEFPFTFGSGTKLEMKGGGGSGGGGSGGGGSQVQLQQSGAELVRPGTSVKVSCKASGYVFTNYWIEWIKQRPGQGLEWIGVMNPGSGETTYNEKFKGKATLTADKSSSTAYMQLSSLTSVDSAVYFCARDHDRDYYAMDYWGQGTSVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5742 - protein, 1142 aa, Artificial Sequence
  Synthetic Polypeptide encoding a CAR with optional accessory module(s)
MALPVTALLLPLALLLHAARPDILLTQSPAILSVSPGERVSFSCRASQNIGTSIHWYQQRTNGSPRLLIKYASESVSGIPSRFSGSGSGTDFTLSINSVESEDIADYYCQHTNSWPTTFGGGTKLEIKRGGGGSGGGGSGGGGSQVQLQQSDAELVKPGASVKISCKASGYTFTDHAIHWVKQKPEQGLEWIGYFSPGNGDIKYNEKFKGKATLTADKSSSTAYMQLNSLTSEDSAVYFCKRSYGNYDYWGQGTTLTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5743 - protein, 1147 aa, Artificial Sequence
  Synthetic Polypeptide encoding a CAR with optional accessory module(s)
MALPVTALLLPLALLLHAARPDIVMTQSPDSLAVSLGERATINCKSSQSLLNSGDQKNYLTWYQQKPGQPPKLLIYWASTRESGVPDRFSGSGSGTDFTLTISSLQAEDVAVYYCQNDYSYPLTFGQGTKVEIKGGGGSGGGGSGGGGSQVQLVQSGAEVKKTGSSVKVSCKASGYTFTDHAIHVWRQAPGQALEWMGHFSPGNTDIKYNDKFKGRVTLTVDRSMSTAYMELSSLRSEDTAMYYCKTSTFFFDYWGQGTMVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5744 - protein, 1069 aa, Artificial Sequence
  Synthetic Polypeptide encoding a CAR with optional accessory module(s)
MELTELLLVVMLLLTARLTLSSPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLLGTQLPPQGRTTAHKDPNAIFLSFQHLLRGKVRFLMLVGGSTLCVRRAPPTTAVPSRTSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5745 - protein, 1146 aa, Artificial Sequence
  Synthetic Polypeptide encoding a CAR with optional accessory module(s)
MALPVTALLLPLALLLHAARPDIQMTQSPSSLSASVGDRVTITCKASQDVSIAVAWYQQKPGKAPKVLIYSASYRYTGVPDRFSGSGSGTDFTFTISSLQPEDIAVYYCQQHYITPLTFGGGTKVEIKGGGGSGGGGSGGGGSQIQLVQSGHEVKKPGASVKVSCKASGYTFTNYGMNWVRQAPGQGLEWMGWINTKTGEPTYAEEFKGRFVFSLETSASTAYLQISSLKAEDTAMYFCGRGGYGSSYWYFDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5746 - protein, 1148 aa, Artificial Sequence
  Synthetic Polypeptide encoding a CAR with optional accessory module(s)
MALPVTALLLPLALLLHAARPDIVMTQSPDSLAVSLGERATINCRASKSVSTSGYSYMHWYQQKPGQPPKLLIYLASNLESGVPDRFSGSGSGTDFTLTISSLQAEDVAVYYCQHSRELPYTFGQGTKLEIKGGGGSGGGGSGGGGSQVQLQESGPGLVKPSETLSLTCTVSGGSISSYGVHWIRQPPGKGLEWIGVIWTSGVTDYNSALMGRVTISVDTSKNQFSLKLSSVTAADTAVYYCARDGDYDRYTMDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5747 - protein, 1127 aa, Artificial Sequence
  Synthetic Polypeptide encoding a CAR with optional accessory module(s)
MTALFLMSMLFGLACGQAMSFCIPTEYTMHIERRECAYCLTINTTICAGYCMTRDINGKLFLPKYALSQDVCTYRDFIYRTVEIPGCPLHVAPYFSYPVALSCKCGKCNTDYSDCIHEAIKTNYCTKPQKSYLVGFSVGGGGSGGGGSGGGGSAPDVQDCPECTLQENPFFSQPGAPILQCMGCCFSRAYPTPLRSKKTMLVQKNVTSESTCCVAKSYNRVTVMGGFKVENHTACHCSTCYYHKSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5748 - protein, 1144 aa, Artificial Sequence
  Synthetic Polypeptide encoding a CAR with optional accessory module(s)
MALPVTALLLPLALLLHAARPQSVLTQPPSVSVSPGQTASITCSGDKLGDKYACWYQQKPGQSPVLVIYQDSKRPSGIPERFSGSNSGNTATLTISGTQAMDEADYYCQAWDSSTAVVFGGGTKLTVLGGGGSGGGGSGGGGSQVQLVQSGAEVKKPGQSLKISCKASGYSLTDNWIGWVRQKPGKGLEWMGIIYPGDSDTRYSPSFQGQVTISADKSINTAYLQWSSLKASDTAIYYCVGLDWNYNPLRYWGPGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5749 - protein, 1142 aa, Artificial Sequence
  Synthetic Polypeptide encoding a CAR with optional accessory module(s)
MALPVTALLLPLALLLHAARPDIVMTQSQKFMSTSVGDRVSIICKASQNVGTFVAWYQQKPGQSPKLLVYSASNRYTGVPDRFTGSGSGTDFTLTINNMQSEDLADYFCRQYSSYPYTFGGGTKLEIKGGGGSGGGGSGGGGSEVQLQQSGPELVKPGASMKISCKASGYSFSAYTMNWVKQSHGKNLEWIGLINPYNGGTNYNQEFEGKATLTVNKSSNTAFMELLSLTSDDSAVYYCARRDWDYFDYWGQGTTLTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5750 - protein, 1153 aa, Artificial Sequence
  Synthetic Polypeptide encoding a CAR with optional accessory module(s)
MALPVTALLLPLALLLHAARPAIQMTQSPSSLSASVGDRVTITCRASQSISNYLNWYQQKPGKAPKLLIYAASSLQSGVPSRFSGSGSGTDFTLTISSLQPEDFATYYCQQSYSSPSTTFGQGTKLEIKRGGGGSGGGGSGGGGSEVQLVESGGGLIQPGGSLRLSCAASGFTVSSNYMSWVRQAPGKGLEWVSVTYSGGSTSYADSVKGRFTISRDNSKNTLYLQMNSLRAEDTAVYYCARGGRYCSSISCYARSGCDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5751 - protein, 1148 aa, Artificial Sequence
  Synthetic Polypeptide encoding a CAR with optional accessory module(s)
MALPVTALLLPLALLLHAARPDIQMTQSPSSLSASVGDRVTITCRASQSIGTSLHWYQQKPGKAPKLLIKFASRLQSGVPSRFSGSGSGTDFTLTISSLQPEDFATYYCQQSPGFPPTFGQGTKLEIKRGGGGSGGGGSGGGGSQVQLVESGGGLVKPGGSLRLSCAASGFSITTSGYYWTWIRQFPGKGLEWMGYIGYNSKTYYNPALKSRITISRDNAKNSLYLQMNSLRAEDTAVYYCARSLYGGYKDAFDSWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5752 - protein, 1153 aa, Artificial Sequence
  Synthetic Polypeptide encoding a CAR with optional accessory module(s)
MALPVTALLLPLALLLHAARPDEIVLTQSPLSLPVTPGEPASISCRSSQSLLHSIGYNYLDWYLQKPGQSPQLLIYLGSNRASGVPDRFSGSGSGTDFTLKISRVEAEDVGVYYCMQALQTPLTFGGGTKVEIKRGGGGSGGGGSGGGGSEVQLVESGGGVVQPGRSLRLSCAASGFTFRSYGMHWVRQAPGKGLEWVAVISYDGSNKYYTDSVNGRFTISRDNSKNTLYLQMNSLRAEDTAVYYCARGGGYYETSGPDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5753 - protein, 1151 aa, Artificial Sequence
  Synthetic Polypeptide encoding a CAR with optional accessory module(s)
MALPVTALLLPLALLLHAARPDDVVMTQSPLSLPVTPGEPASISCRSSQSLLHSIGYNYLHWFLQKPGQSPQLLIYLGSNRASGVPDRFSGSGSGTDFTLKISRVEAEDVGVYYCMQALQTPPTFGQGTRLEIKRGGGGSGGGGSGGGGSQLQLQESGPGLVKPSGTLSLTCAVSGGSISSSNWWSWVRQPPGKGLEWIGEIYHSGSTNYNPSLKSRVTISVDKSKNQFSLKLSSVTAADTAVYYCVGSPYGDYVLDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5754 - protein, 1154 aa, Artificial Sequence
  Synthetic Polypeptide encoding a CAR with optional accessory module(s)
MALPVTALLLPLALLLHAARPDVVMTQSPLSLPVTPGEPASISCRSSQSLLHSNGHNYLDWYLQKPGQSPQLLIYLGSNRASGVPDRFSGSGSGTDFTLKISRVEAEDVGVYYCMQTLQTPLTFGPGTKVDIKRGGGGSGGGGSGGGGSEVQLVETGGGVVQPGRSLRLSCAASGFTFSSYGMHWVRQAPGKGLEWVAVISYDGSNKYYADSVKGRFTISRDNSKNTLYLQMNSLRAEDTAVYYCAKDRYGWGSSFGHFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5755 - protein, 1149 aa, Artificial Sequence
  Synthetic Polypeptide encoding a CAR with optional accessory module(s)
MALPVTALLLPLALLLHAARPDEIVLTQSPGTLSLSLGERATLSCRASQSISSSFLAWYQQKPGQAPKLLIYAASTRATGIPDRFSGSGSGTDFTLTISRLEPEDFAVYYCQQYGRSLSFGGGTKVEVKGGGGSGGGGSGGGGSQVQLQQSGPGLVKPSQTLSLTCAISGDSVSGNSATWNWIRQSPSRGLEWLGRTYYRSKWNHDYAESVKSRITINPDTSKNQFSLQLNSVTPEDTAVYYCARGDSSSWYAFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5756 - protein, 1149 aa, Artificial Sequence
  Synthetic Polypeptide encoding a CAR with optional accessory module(s)
MALPVTALLLPLALLLHAARPDQTVVTQPPSASGTPGQRVTISCSGSSSNIGSNYVYWYQQLPGTAPKLLIYRSNQRPSGVPDRFSGSKSGTSASLAISGPRSVDEADYYCAAWDDSLNGVVFGGGTKLTVLGGGGGSGGGGSGGGGSQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARRIPPYYGMDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5757 - protein, 1149 aa, Artificial Sequence
  Synthetic Polypeptide encoding a CAR with optional accessory module(s)
MALPVTALLLPLALLLHAARPDQSVVTQPPSVSVAPGKTARITCGRNNIGSKSVHWYQQKPGQAPVLVVYDDSDRPSGIPERFSGSNSGNTATLTISRVEAGDEADYYCQVWDSSSDHVVFGGGTKLTVLGGGGGSGGGGSGGGGSEVQLVQSGGGVVRPGGSLRLSCAASGFTFDDYGMSWVRQAPGKGLEWVSGINWNGGSTGYADSVRGRFTISRDNAKNSLYLQMNSLRAEDTALYYCARERGYGYHDPHDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5758 - protein, 1161 aa, Artificial Sequence
  Synthetic Polypeptide encoding a CAR with optional accessory module(s)
MALPVTALLLPLALLLHAARPEQKLISEEDLEFQAVVTQPPSASGTPGQRVTISCSGSSSNIGSNTVNWYQQVPGTAPKLLIYSNNQRPSGVPDRFSGSKSGTSASLAISGLQSEDEADYYCAAWDDSLNGWVFGGGTKLTVLGGGGSGGGGSGGGGSQMQLVQSGAEVKEPGESLRISCKGSGYSFTNFWISWVRQMPGKGLEWMGRVDPGYSYSTYSPSFQGHVTISADKSTSTAYLQWNSLKASDTAMYYCARVQYSGYYDWFDPWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5759 - protein, 1155 aa, Artificial Sequence
  Synthetic Polypeptide encoding a CAR with optional accessory module(s)
MALPVTALLLPLALLLHAARPEQKLISEEDLEFDIQMTQSPSTLSASVGDRVTITCRASQNINKWLAWYQQRPGKAPQLLIYKASSLESGVPSRFSGSGSGTEYTLTISSLQPDDFATYYCQQYNSYATFGQGTKVEIKRGGGGSGGGGSGGGGSQVQLVQSGAEVKKPGESLKISCKGSGYNFSNKWIGWVRQLPGRGLEWIAIIYPGYSDITYSPSFQGRVTISADTSINTAYLHWHSLKASDTAMYYCVRHTALAGFDYWGLGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5760 - protein, 1145 aa, Artificial Sequence
  Synthetic Polypeptide encoding a CAR with optional accessory module(s)
MALPVTALLLPLALLLHAARPEIVLTQSPGTLSLSPGERATLSCRASQSVSNTYLAWYHQRPGQAPRLLIYGASSRATGIPDRFSGSGSGTDFALTISSLEPEDFAVYYCQQYSNSWTFGQGTKVEIKRGGGGSGGGGSGGGGSQVQLVESGGGVVQPGRSLRLSCAASGFTFSSYDMHWVRQAPGKGLEWVAVISYDGTNEYYADSVKGRFTISRDTSKNTLYLQMNSLRAEDTAVYYCARERYFDWSFDYWGQGTLVSVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5761 - protein, 1144 aa, Artificial Sequence
  Synthetic Polypeptide encoding a CAR with optional accessory module(s)
MALPVTALLLPLALLLHAARPELTQDPAVSVALGQTVRITCQGDSLRSNYANWYQQKPGQAPVLVIYGQNNRPSGIPDRFSGSSSGNTASLTITGAQAADEADYYCDSRVSTGNHVVFGGGTKLTVLGQGGGGSGGGGSGGGGSEVQLVQSGAEVKKPGASVKVSCKASGYTFTSYAMHWVRQAPGQRLEWMGWINAGNGNTKYSQKFQGRVTITRDTSASTAYMELSSLRSEDTAVYYCARDISYGSFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5762 - protein, 1146 aa, Artificial Sequence
  Synthetic Polypeptide encoding a CAR with optional accessory module(s)
MALPVTALLLPLALLLHAARPDIVLTQTPATLSVTPGDSVSLSCRASQSISNNLHWYQQKSHESPRLLIKNASQSISGIPSKFSGSGSGTDFTLRINSVETEDFGMYFCQQSNSWPYTFGSGTKLEIKGGGGSGGGGSGGGGSQVKLQQSGPELVKPGASVKISCKASGYSFTGYYMHWVKQSHGNILDWIGYIYPYNGVSSYNQKFKGKATLTVDKSSSTAYMELRSLTSEDSAVYYCARERGLYQLRAMDYWGQGTSVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5763 - protein, 1137 aa, Artificial Sequence
  Synthetic Polypeptide encoding a CAR with optional accessory module(s)
MALPVTALLLPLALLLHAARPDIVMTQTPAIMSASPGQKVTITCSASSSVNYMHWYQQKLGSSPKLWIYDTSKLAPGVPARFSGSGSGTSYSLTISSMEAEDAASYFCHQWSSYPYTFGSGTKLEIKGGGGSGGGGSGGGGSEVQLQESGPDLVKPSQSLSLTCTVTGYSITSGYGWHWIRQFPGNKLEWMGYIHYSGSTTYNPSLKSRISISRDTSKNQFFLQLNSVTTEDTATYYCARSLRYWGQGTTLTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5764 - protein, 1140 aa, Artificial Sequence
  Synthetic Polypeptide encoding a CAR with optional accessory module(s)
MALPVTALLLPLALLLHAARPDIQMTQSPSSLSASVGDRVTITCSATSSISYMHWYQQKPGKAPKGWIYDTSKLAHGVPSRFSGSGSGTDFTLTISSLQPEDFATYYCHQRRSYPFTFGQGTKVEIKGGGGSGGGGSGGGGSEVQLVQSGAEVKKPGASVKVSCKASGYTFTNFWIHWVRQAPGQGLEWIGEIDPSDSYTNYNQKFKGRVTITRDTSTSTAYLELSSLRSEDTAVYYCAREITTVDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5765 - protein, 1147 aa, Artificial Sequence
  Synthetic Polypeptide encoding a CAR with optional accessory module(s)
MALPVTALLLPLALLLHAARPDIQMTQSPSSLSASVGDRVTITCKASQGFNKYVAWYQQKPGKAPKLLIYYTSTLQPGVPSRFSGSGSGRDYTLTISSLQPEDFATYYCLQYGNLLYAFGQGTKVEIKRGGGGSGGGGSGGGGSEVQLVQSGAEVKKPGASVKVSCKASGYTFTSYWIGWVRQAPGQGLEWIGDIYPGGGYTNYNEKFKGRVTITRDTSTSTAYLELSSLRSEDTAVYYCARLDGSSYRGAMDSWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5766 - protein, 1151 aa, Artificial Sequence
  Synthetic Polypeptide encoding a CAR with optional accessory module(s)
MALPVTALLLPLALLLHAARPDIQLTQSPSSLSASVGDRVTITCRASQSVDYDGDSYMNWYQQKPGKAPKLLIYAASYLESGVPSRFSGSGSGTDFTLTISSLQPEDFATYYCQQSHEDPYTFGQGTKVEIKRGGGGSGGGGSGGGGSEVQLVESGGGLVQPGGSLRLSCAVSGYSITSGYSWNWIRQAPGKGLEWVASITYDGSTNYNPSVKGRITISRDDSKNTFYLQMNSLRAEDTAVYYCARGSHYFGHWHFAVWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5767 - protein, 1143 aa, Artificial Sequence
  Synthetic Polypeptide encoding a CAR with optional accessory module(s)
MALPVTALLLPLALLLHAARPDIQMTQSPSSLSASVGDRVTITCRASQDIRYYLNWYQQKPGKAPKLLIYVASSLQSGVPSRFSGSGSGTEFTLTVSSLQPEDFATYYCLQVYSTPRTFGQGTKVEIKGGGGSGGGGSGGGGSEVQLVESGGGLAKPGGSLRLSCAASGFRFTFNNYYMDWVRQAPGQGLEWVSRISSSGDPTWYADSVKGRFTISRENAKNTLFLQMNSLRAEDTAVYYCASLTTGSDSWGQGVLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5768 - protein, 1144 aa, Artificial Sequence
  Synthetic Polypeptide encoding a CAR with optional accessory module(s)
MALPVTALLLPLALLLHAARPEIVMTQSPATLSVSPGERATLSCRASQSVSRNLAWYQQKPGQAPRLLIYGASTRATGIPARFSGSGSGTEFTLTIGSLQSEDFAVYYCQQYKTWPRTFGQGTNVEIKGGGGSGGGGSGGGGSQVQLQQWGAGLLKPSETLSLTCAVFGGSFSGYYWSWIRQPPGKGLEWIGEINHRGNTNDNPSLKSRVTISVDTSKNQFALKLSSVTAADTAVYYCARERGYTYGNFDHWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5769 - protein, 1145 aa, Artificial Sequence
  Synthetic Polypeptide encoding a CAR with optional accessory module(s)
MALPVTALLLPLALLLHAARPEIVMTPSSATLSVSPGERATLSCRASQSVSRNLAWYQQKPGQAPRLLIYGASTRATGIPARFSGSGSGTEFTLTISSLQSEDFAVYYCHQYSNWMCSFGQGTKLEIKGGGGSGGGGSGGGGSEVQLLESGGGLVQPGGSLRLSCAASGFTFSRYAMNWVRQAPGKGLEWVSGISGSGGRTYYADSVKGRFTISRDNSKNTLYLQMNSLRAEDTAVYYCAKDRDFWSGPFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5770 - protein, 1145 aa, Artificial Sequence; identical to SEQ ID NO: 5769
  Synthetic Polypeptide encoding a CAR with optional accessory module(s)

SEQ ID NO: 5771 - protein, 1147 aa, Artificial Sequence
  Synthetic Polypeptide encoding a CAR with optional accessory module(s)
MALPVTALLLPLALLLHAARPQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSELVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5772 - protein, 1148 aa, Artificial Sequence
  Synthetic Polypeptide encoding a CAR with optional accessory module(s)
MALPVTALLLPLALLLHAARPEVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDKGGGYYDFWSGSDYWGQGTLVTVSSGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCNSRDSSGWVFGGGTKLTVLTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5773 - protein, 1157 aa, Artificial Sequence
  Synthetic Polypeptide encoding a CAR with optional accessory module(s)
MALPVTALLLPLALLLHAARPEVQLQQSGPGLVKPSQTLSLTCAISGDSVLSNSDTWNWIRQSPSRGLEWLGRTYHRSTWYDDYASSVRGRVSINVDTSKNQYSLQLNAVTPEDTGVYYCARDRLQDGNSWSDAFDVWGQGTMVTVSSGGGGSGGGGSGGGGSQSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTLVYVFGTGTKVTVLTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5774 - protein, 1155 aa, Artificial Sequence
  Synthetic Polypeptide encoding a CAR with optional accessory module(s)
MALPVTALLLPLALLLHAARPQVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARGDSNYWSYYGMDVWGQGTLVTVSSGGGGSGGGGSGGGGSGGGGSQSVLTQPRSVSGSPGQSVTISCTGTSSDVGGYNYVSWYQQHPGEAPKLIIYDADKRPSGISNRFSSGKSGNTASLTISGLQVEDEADYYCCSYAGGSTWVFGGGTKVTVLTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5775 - protein, 1157 aa, Artificial Sequence
  Synthetic Polypeptide encoding a CAR with optional accessory module(s)
MALPVTALLLPLALLLHAARPEVQLQQSGPGLVKPSQTLSLTCAISGDSVSSNSAAWNWIRQSPSRGLEWLGRTYYRSKWYSDYAVSVKSRITINPDTSKNQFSLQLNSVTPEDTAVYYCARDPYDFWSGYPDAFDIWGQGTMVTVSSGGGGSGGGGSGGGGSQSALTQPASVSGSPGQSITISCTGTSSDVGGYNYVSWYQQHPGKAPKVIISEVNNRPSGVSHRFSGSKSGNTASLTISGLQAEDEADYFCSSYTSGRTLYVFGTGSKVTVLGTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5776 - protein, 1156 aa, Artificial Sequence
  Synthetic Polypeptide encoding a CAR with optional accessory module(s)
MALPVTALLLPLALLLHAARPEVQLQQSGPGLVKPSQTLSLTCAISGDSMLSNSDTWNWIRQSPSRGLEWLGRTYHRSTWYDDYASSVRGRVSINVDTSKNQYSLQLNAVTPEDTGVYYCARVRLQDGNSWSDAFDVWGQGTMVTVSSGGGGSGGGGSGGGGSQSALTQPASASGSPGQSVTISCTGTSSDVGGYNYVSWYQQHPGKAPKLMIYDVSNRPSGVSNRFSGSKSGNTASLTISGLQAEDEADYYCSSYTSSSTLYVFGTGTQLTVLTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5777 - protein, 1147 aa, Artificial Sequence; identical to SEQ ID NO: 5771
  Synthetic Polypeptide encoding a CAR with optional accessory module(s)

SEQ ID NO: 5778 - protein, 1156 aa, Artificial Sequence
  Synthetic Polypeptide encoding a CAR with optional accessory module(s)
MALPVTALLLPLALLLHAARPDVMLTQTPLSLPVSLGDQASISCRSSQSILHSTGDTYLEWYLQKPGQSPKLLINKVSNRLSGVPDRFSGSGSGTDFTLKISRVEAEDLGVYYCFQGSHVPWTFGGGTKLEIKRADAAPTVSIFPGGGGSGGGGSGGGGSQVKLQQSGPSLVKPGASVKMSCKASGYTFTDFYMKWVKQSHGKSLEWIGDINPNIGDTFYNQKFKGKATLTVDKSSSTAYMQLNSLTSEDSAVYFCSVGYFDVWGAGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5779 - protein, 1152 aa, Artificial Sequence
  Synthetic Polypeptide encoding a CAR with optional accessory module(s)
MALPVTALLLPLALLLHAARPEIVLTQSPATLSLSPGERATLSCRASQSVSIYLAWYQQKPGQAPRLLIYDASNRATGIPARFSGSGSGTDFTLTISSLEPEDFAVYYCQQRSNWPPFTFGPGTKVDIKGGGGSGGGGSGGGGSQVQLVESGGGVVQPGRSLRLSCAASGFTFSSYGMHWVRQAPGKGLEWVAVIWDDGSNKYYVDSVKGRFTISRDNSKNTLYLQMNSLRAEDTAVYYCARDDYYGSGSFNSYYGTDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5780 - protein, 1137 aa, Artificial Sequence
  Synthetic Polypeptide encoding a CAR with optional accessory module(s)
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKGGGGSGGGGSGGGGSEVQLVQSGGGLVHPGGSLRLSCAGSGFTFSTYLMYWVRQAPGKTLEWVSAIGSGGDTYYADSVKGRFTISRDNAKNSLYLQMNSLRAEDMAVYYCARGLGYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5781 - protein, 1156 aa, Artificial Sequence
  Synthetic Polypeptide encoding a CAR with optional accessory module(s)
MALPVTALLLPLALLLHAARPLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGGGGSGGGGSGGGGSEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5782 - protein, 1146 aa, Artificial Sequence
  Synthetic Polypeptide encoding a CAR with optional accessory module(s)
MALPVTALLLPLALLLHAARPQSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSVFGTGTKVLVLGGGGSGGGGSGGGGSQVQLVQSGAEVKKPGSSVKVSCKASGGTFSSYTINVWRQAPGQGLEWMGGFIPISGTVNYAQKFQGRVTITADESTSTAYMELSSLRSEDTAVYYCARPLDWTEDIWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5783 - protein, 1149 aa, Artificial Sequence
  Synthetic Polypeptide encoding a CAR with optional accessory module(s)
MALPVTALLLPLALLLHAARPNFMLTQPHSVSESPGKTVTISCTGSSGSIASNYVQWYQQRPGSAPTILIYEDNKRPSGVPDRFSGSIDSSSNSASLTISGLKTGDEADYYCQSYDDINHWVFGGGTKLTVLGGGGGSGGGGSGGGGSEVQLVQSGAEVKKPGASVKVSCKASGYTFTAYYLHWLRQAPGQGLEWMGWMNTNNGATRYAQKFQDRVTMTRDTSINTAYMEMSGLSSDDTAMYYCARGDISQDFADVWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5784 - protein, 1141 aa, Artificial Sequence
  Synthetic Polypeptide encoding a CAR with optional accessory module(s)
MALPVTALLLPLALLLHAARPQIVLTQSPAIMSASPGEKVTITCSASSSVSYMHWFQQKPGTSPKLWIYSTSNLASGVPARFSGSGSGTSYSLTISRMEAEDAATYYCQQRSSYPPTFGGGTKLEIKGGGGSGGGGSGGGGSQVQLQQSGAELMKPGASVKISCKATGYTFSSYWIEWVKQRPGHGLEWIGEILPGSGSTNYNEKFKGKATFTADTSSNTAYMQLSSLTSEDSAVYYCARYDYPWFAYWGQGTLVTVSATREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5785 - protein, 1149 aa, Artificial Sequence
  Synthetic Polypeptide encoding a CAR with optional accessory module(s)
MALPVTALLLPLALLLHAARPDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPFTFGSGTKLEIKGGGGSGGGGSGGGGSQVQLQQPGAELVRPGASVKLSCKASGYTFTSYWINWVKQRPGQGLEWIGNIYPSDSYTNYNQKFKDKATLTVDKSSSTAYMQLSSPTSEDSAVYYCTRSWRGNSFDYWGQGTTLTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5786 - protein, 1147 aa, Artificial Sequence
  Synthetic Polypeptide encoding a CAR with optional accessory module(s)
MALPVTALLLPLALLLHAARPDTQMTQSPSSVSASVGDRVTITCRTSQDISNYLNWYQQKPGKAPKLLIYNTSRLHSGVPSRFSGSGSGTDFTLTISSLQPEDFATYYCQQSNMFPYTFGQGTKLEIKGGGGSGGGGSGGGGSQVQLVQSGAEVKKPGASVKVSCKASGYTFNGYFMNWVRQAPGQGLERMGRINPNNGDSFYNQKFQGRVTMTRDTSTSTVYMELPSLRSEDTAVYYCAREGYYGGRGYALDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5787 - protein, 1152 aa, Artificial Sequence
  Synthetic Polypeptide encoding a CAR with optional accessory module(s)
MALPVTALLLPLALLLHAARPDIVMTQSPSSLAMSVGQKVTMTCKSSQSLLNSSNQKNYLAWYQQKPGQSPKLLVYFASTRESGVPDRFIGSGSGTDFTLTISSVQAEDLADYFCHQHYSTPLTFGAGTKLELKGGGGSGGGGSGGGGSEVQLQQSGPDLVKPGASVKMSCKASGYTFTSYVMHWVKQKPGQGLEWIGYIYPYNDGTKYNEKFKGKATLTSDKSSSTAYMELSSLTSEDSAVYYCAREEYGNYVRYFDVWGAGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5788 - protein, 1146 aa, Artificial Sequence
  Synthetic Polypeptide encoding a CAR with optional accessory module(s)
MALPVTALLLPLALLLHAARPQSVVTQPPSVSAAPGQKVTISCSGSSSNIGNNYVSWYQQLPGTAPKLLIYDNNKRPSGIPDRFSASKSGTSATLGITGLQTRDEADYYCGTWDSSLSAWVFGGGTKLTVLGGGGGSGGGGSGGGGSQVQLVQSGAEVKKPGSSVKVSCKASGDTFSSYYISWVRQAPGQGLEWMGRIIPILGIANYAQKYQGRVTLSADKSTSTSYMELNSLSSEDTAVYYCALDWSYSIDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5789 - protein, 1152 aa, Artificial Sequence
  Synthetic Polypeptide encoding a CAR with optional accessory module(s)
MALPVTALLLPLALLLHAARPEFEVKLVESGGGLVKFGGSLKLSCAASGFTLSSYYMSWVRQSPEKRLELVAVINSNGGSTYYPDTVKGRFTISRDNAKNTLYLQMSSLKSEDTALYYCARPFYYSNSPFAYWGQGTLVTVSAGGGGSGGGGSGGGGSDVLMTQTPLSLPVSLGDQASISCRSSQSIVHRTGNTYLEWYLQKPGQSPKLLIYKVSNRFSGVPDRFSGSGSGTDFTLKISRVGAEDLGVYYCFQGSHVPYTFGGGTKLEIKTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5790 - protein, 1149 aa, Artificial Sequence
  Synthetic Polypeptide encoding a CAR with optional accessory module(s)
MALPVTALLLPLALLLHAARPELVMTQSPASLAVSLGQRATISCRASESVDSYGKSFMHWYQLKPGQPPKLLIYRASNLESGVPARFSGSGSRTDFTLTIDPVEADDAATYYCQQNNEDPWTFGGGTKLEIKGGGGSGGGGSGGGGSEVQLEQSGPELVKPGASVKMSCKASGYTFTNYYMKWVKQSHGKSLEWIGDLNPNNGDTFYNQKFKGKATLTVDKSSNTAYMQLNSLTSEDSAVYYCARTGRYEENAMDYWGQGTSVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5791 - protein, 1143 aa, Artificial Sequence
  Synthetic Polypeptide encoding a CAR with optional accessory module(s)
MALPVTALLLPLALLLHAARPDVVMTQSPSSLSASVGDRVTITCMASEDIYIRLAWYQQKPGNAPKLLIYAATSLETGVPSRFSGSGSGTDFTLTISSLQPEDFATYYCQQYWSSPWTFGGGTKVEIKGGGGSGGGGSGGGGSQVQLQESGPGLVKPSQTLSLTCTVSGYSITSDYTWNWIRQPPGNGLEWIGYITYSGSTSYNPSLKSRVLISVDTSKNQVSLKLSSVTAADTAVYYCARLGRRYTMDYWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5792 - protein, 1150 aa, Artificial Sequence
  Synthetic Polypeptide encoding a CAR with optional accessory module(s)
MALPVTALLLPLALLLHAARPDVLMTQTPVSLSVSLGDQASISCRSSQSIVHSTGNTYLEWYLQKPGQSPKLLIYKISNRFSGVPDRFSGSGSGTDFTLKISRVEAEDLGVYYCFQASHAPRTFGGGTKLEIKRGGGGSGGGGSGGGGSEVILVESGGGLVKPGGSLKLSCAASGFTFSSYTMSWVRQTPEKRLEWVATISSGGGNTYYPDSVKGRFTISRDNAKNNLYLQMSSLRSEDTALYYCARYYRYEAWFASWGQGTLVTVSATREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5793 - protein, 1020 aa, Artificial Sequence
  Synthetic Polypeptide encoding a CAR with optional accessory module(s)
MALPVTALLLPLALLLHAARPQVKLEESGGGLVQAGRSLRLSCAASEHTFSSHVMGWFRQAPGKERESVAVIGWRDISTSYADSVKGRFTISRDNAKKTLYLQMNSLKPEDTAVYYCAARRIDAADFDSWGQGTQVTVSSEQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5794 - protein, 1019 aa, Artificial Sequence
  Synthetic Polypeptide encoding a CAR with optional accessory module(s)
MALPVTALLLPLALLLHAARPEVQLVESGGGLVQAGGSLRLSCAASGRTFTMGWFRQAPGKEREFVAAISLSPTLAYYAESVKGRFTISRDNAKNTVVLQMNSLKPEDTALYYCAADRKSVMSIRPDYWGQGTQVTVSSEQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5795 - protein, 1153 aa, Artificial Sequence
  Synthetic Polypeptide encoding a CAR with optional accessory module(s)
MALPVTALLLPLALLLHAARPQVKLEESGGGLVQAGRSLRLSCAASEHTFSSHVMGWFRQAPGKERESVAVIGWRDISTSYADSVKGRFTISRDNAKKTLYLQMNSLKPEDTAVYYCAARRIDAADFDSWGQGTQVTVSSGGGGSGGGGSGGGGSEVQLVESGGGLVQAGGSLRLSCAASGRTFTMGWFRQAPGKEREFVAAISLSPTLAYYAESVKGRFTISRDNAKNTVVLQMNSLKPEDTALYYCAADRKSVMSIRPDYWGQGTQVTVSSEQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5796 - protein, 1017 aa, Artificial Sequence
  Synthetic Polypeptide encoding a CAR with optional accessory module(s)
MALPVTALLLPLALLLHAARPEVQLVESGGGLVQAGGSLRLSCIATGKVFSIYDMGWYRQAPGKQRELVAEITSSGTTHYDDFVSGRFTISRDNAKNTVYLQMNTLKAEDTAVYYCRANHVFGGSYWGQGTQVTVSSEQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5797 - protein, 1023 aa, Artificial Sequence
  Synthetic Polypeptide encoding a CAR with optional accessory module(s)
MALPVTALLLPLALLLHAARPQVQLVESGGGLVQPGGSLRLSCEASGFTLDYYAIGWFRQAPGKEREGVICISRSDGSTYYADSVKGRFTISRDNAKKTVYLQMISLKPEDTAAYYCAAGADCSGYLRDYEFRGQGTQVTVSSEQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5798 - protein, 1146 aa, Artificial Sequence
  Synthetic Polypeptide encoding a CAR with optional accessory module(s)
MALPVTALLLPLALLLHAARPEVQLVESGGGLVQAGGSLRLSCIATGKVFSIYDMGWYRQAPGKQRELVAEITSSGTTHYDDFVSGRFTISRDNAKNTVYLQMNTLKAEDTAVYYCRANHVFGGSYWGQGTQVTVSSEVAALEKQVQLVESGGGLVQPGGSLRLSCEASGFTLDYYAIGWFRQAPGKEREGVICISRSDGSTYYADSVKGRFTISRDNAKKTVYLQMISLKPEDTAAYYCAAGADCSGYLRDYEFRGQGTQVTVSSEQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5799 - protein, 1029 aa, Artificial Sequence
  Synthetic Polypeptide encoding a CAR with optional accessory module(s)
MALPVTALLLPLALLLHAARPQVKLEESGGRLVQPRGSLRLSCAGSGRTFSTYGMAWFRQAPGKEREFVASKASMNYSGRTYYADSVKGRFTIARDNAKNMVFLQMNNLKPEDTAVYYCAAGTGCSTYGCFDAQIIDYWGKGTLVTVSSEQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5800 - protein, 1020 aa, Artificial Sequence
  Synthetic Polypeptide encoding a CAR with optional accessory module(s)
MALPVTALLLPLALLLHAARPQVKLEESGGGLVQPGESLRLSCSASGSIFKVFRVFAMSWYRQGPGKQRELVASISSGETTTYADSVKGRFTISRDNAKNTAYLQMDSLKPEDTAVYYCNADHTFTGDFWGQGTQVTVSSEQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5801 - protein, 1155 aa, Artificial Sequence
  Synthetic Polypeptide encoding a CAR with optional accessory module(s)
MALPVTALLLPLALLLHAARPQVKLEESGGRLVQPRGSLRLSCAGSGRTFSTYGMAWFRQAPGKEREFVASKASMNYSGRTYYADSVKGRFTIARDNAKNMVFLQMNNLKPEDTAVYYCAAGTGCSTYGCFDAQIIDYWGKGTLVTVSSEVAALEKQVKLEESGGGLVQPGESLRLSCSASGSIFKVFRVFAMSWYRQGPGKQRELVASISSGETTTYADSVKGRFTISRDNAKNTAYLQMDSLKPEDTAVYYCNADHTFTGDFWGQGTQVTVSSEQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5802 - protein, 1018 aa, Artificial Sequence
  Synthetic Polypeptide encoding a CAR with optional accessory module(s)
MALPVTALLLPLALLLHAARPQVKLEESGGELVQPGGPLRLSCAASGNIFSINRMGWYRQAPGKQRAFVASITVRGITNYADSVKGRFTISVDKSKNTIYLQMNALKPEDTAVYYCNAVSSNRDPDYWGQGTQVTVSSEQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5803 - protein, 1030 aa, Artificial Sequence
  Synthetic Polypeptide encoding a CAR with optional accessory module(s)
MALPVTALLLPLALLLHAARPPVQLVESGGGLVQAGDSLRLSCAASGRTFGIGTMGWFRQPPGKEREFVAAIRWSTGGTRYADSVKGRFTISRDNAKLTVDLQMDSLKPEDTAVYYCAADRLSLDLSGRYHYNPAVYDYWGQGTQVTVSSEQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5804 - protein, 1162 aa, Artificial Sequence
  Synthetic Polypeptide encoding a CAR with optional accessory module(s)
MALPVTALLLPLALLLHAARPQVKLEESGGELVQPGGPLRLSCAASGNIFSINRMGWYRQAPGKQRAFVASITVRGITNYADSVKGRFTISVDKSKNTIYLQMNALKPEDTAVYYCNAVSSNRDPDYWGQGTQVTVSSGGGGSGGGGSGGGGSPVQLVESGGGLVQAGDSLRLSCAASGRTFGIGTMGWFRQPPGKEREFVAAIRWSTGGTRYADSVKGRFTISRDNAKLTVDLQMDSLKPEDTAVYYCAADRLSLDLSGRYHYNPAVYDYWGQGTQVTVSSEQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5805 - protein, 1020 aa, Artificial Sequence
  Synthetic Polypeptide encoding a CAR with optional accessory module(s)
MALPVTALLLPLALLLHAARPAVQLVESGGGLVQAGDSLRLTCTASGRAFSTYFMAWFRQAPGKEREFVAGIAWSGGSTAYADSVKGRFTISRDNAKNTVYLQMNSLKSEDTAVYYCASRGIEVEEFGAWGQGTQVTVSSEQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5806 - protein, 1021 aa, Artificial Sequence
  Synthetic Polypeptide encoding a CAR with optional accessory module(s)
MALPVTALLLPLALLLHAARPQVQLVESGGGLVQAGGSLRLSCAASGGTLSKNTVAWFRQAPGKERGFVASITWDGRTTYYADSVKGRFTISRDNAKNTVYLQMNSLKPEDTAVYVCADLGKWPAGPADYWGQGTQVTVSSEQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5807 - protein, 1147 aa, Artificial Sequence
  Synthetic Polypeptide encoding a CAR with optional accessory module(s)
MALPVTALLLPLALLLHAARPAVQLVESGGGLVQAGDSLRLTCTASGRAFSTYFMAWFRQAPGKEREFVAGIAWSGGSTAYADSVKGRFTISRDNAKNTVYLQMNSLKSEDTAVYYCASRGIEVEEFGAWGQGTQVTVSSPGGGGSPQVQLVESGGGLVQAGGSLRLSCAASGGTLSKNTVAWFRQAPGKERGFVASITWDGRTTYYADSVKGRFTISRDNAKNTVYLQMNSLKPEDTAVYVCADLGKWPAGPADYWGQGTQVTVSSEQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5808 - protein, 1175 aa, Artificial Sequence
  Synthetic Polypeptide encoding a CAR with optional accessory module(s)
MALPVTALLLPLALLLHAARPAVQLVESGGGLVQAGDSLRLTCTASGRAFSTYFMAWFRQAPGKEREFVAGIAWSGGSTAYADSVKGRFTISRDNAKNTVYLQMNSLKSEDTAVYYCASRGIEVEEFGAWGQGTQVTVSSPGGGGSPQVQLVESGGGLVQAGGSLRLSCAASGGTLSKNTVAWFRQAPGKERGFVASITWDGRTTYYADSVKGRFTISRDNAKNTVYLQMNSLKPEDTAVYVCADLGKWPAGPADYWGQGTQVTVSSEVAALEKEVAALEKEVAALEKEVAALEKEQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5809 - protein, 1149 aa, Artificial Sequence
  Synthetic Polypeptide encoding a CAR with optional accessory module(s)
MALPVTALLLPLALLLHAARPEIVLTQSPATLSLSPGERATLSCSASSSVSYMYWYQQKPGQAPRLLIYRTSNLASGIPARFSGSGSGTDFTLTISSLEPEDFAVYYCQQYHSYPTTFGQGTKVEIKRTVGGGGSGGGGSGGGGSEVQLVESGGGLVQPGGSLRLSCAASGFSFNTYAMNWVRQAPGKGLEWVSHIRSKSNNFATYYADSVKDRFTISRDNAKNSLYLQMNSLRAEDTAVYYCARQGGDFPMDYWGQGTLVTVSSTRTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5810 - protein, 1143 aa, Artificial Sequence
  Synthetic Polypeptide encoding a CAR with optional accessory module(s)
MALPVTALLLPLALLLHAARPDVVMTQSPSSLSASVGDRVTITCKASEDIYIRLAWYQQKPGKAPKLLIYAATSLETGVPSRFSGSGSGTDFTLTISSLQPEDFATYYCQQYWTTPWTFGGGTKVEIKGGGGSGGGGSGGGGSQVQLQESGPGLVKPSQTLSLTCTVSGYSITIDYTWNWIRQPPGKGLEWIGYITYSGSTDYNPSLKSRVLISVDTSKNQVSLKLSSVTAADTAVYYCARLGRRYALDYWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5811 - protein, 1148 aa, Artificial Sequence
  Synthetic Polypeptide encoding a CAR with optional accessory module(s)
MALPVTALLLPLALLLHAARPDIQLTQSPSFLSASVGDRVTITCRASQGISTDLNWYQQKPGKAPKLLIYAASNLESGVPSRFSGSGSGTEFTLTISSLQPEDFATYYCQQSYNWPYTFGGGTKVEIKRGGGGSGGGGSGGGGSEVQLVESGGGLVKPGGSLRLSCAASGFTFSNFEMNWVRQAPGKGLEWVSGISSNGRYINYADSVKGRFTISRDNAKNSLYLQMNSLRAEDTAVYYCARVVDFDQDYNGFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5812 - protein, 1146 aa, Artificial Sequence
  Synthetic Polypeptide encoding a CAR with optional accessory module(s)
MALPVTALLLPLALLLHAARPDIQLTQSPSFLSASVGDRVTITCSLSLGISTWRDWFPPRLGRGLEPLTYAASTLQSGVPSRFSGSGSGTEFTLTISSLQPEDFATYYCQQLNSYPLTFGGGTKVEIKRGGGGSGGGGSGGGGSEVQLVESGGGLVKPGGSLRLSCAASGFTFSTYGMSWVRQAPGKGLEWVAYINNGSGYIYYADSVKGRFTISRDNAKNSLYLQMNSLRAEDTAVYYCARGQWWSGGDFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5813 - protein, 1133 aa, Artificial Sequence
  Synthetic Polypeptide encoding a CAR with optional accessory module(s)
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSRVDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5814 - protein, 1133 aa, Artificial Sequence
  Synthetic Polypeptide encoding a CAR with optional accessory module(s)
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5815 - protein, 1133 aa, Artificial Sequence
  Synthetic Polypeptide encoding a CAR with optional accessory module(s)
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5816 - protein, 1134 aa, Artificial Sequence
  Synthetic Polypeptide encoding a CAR with optional accessory module(s)
MALPVTALLLPLALLLHAARPDEIVLTQSPATLSLSPGERATLSCSASSSVSYMHWYQQKPGQAPRLLIYDTSKLASGIPARFSGSGSGTDFTLTISSLEPEDVAVYYCFQGSVYPFTFGQGTKLEIKRGGGGSGGGGSGGGGSQVQLQESGPGLVKPSQTLSLTCTVSGGSISTSGMGVGWIRQHPGKGLEWIGHIWWDDDKRYNPALKSRVTISVDTSKNQFSLKLSSVTAADTAVYYCARMELWSYYFDYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5817 - protein, 1141 aa, Artificial Sequence
  Synthetic Polypeptide encoding a CAR with optional accessory module(s)
MALPVTALLLPLALLLHAARPDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5818 - protein, 1140 aa, Artificial Sequence
  Synthetic Polypeptide encoding a CAR with optional accessory module(s)
MALPVTALLLPLALLLHAARPDIVMTQAAPSIPVTPGESVSISCRSSKSLLNSNGNTYLYWFLQRPGQSPQLLIYRMSNLASGVPDRFSGSGSGTAFTLRISRVEAEDVGVYYCMQHLEYPFTFGAGTKLELKRGGGGSGGGGSGGGGSEVQLQQSGPELIKPGASVKMSCKASGYTFTSYVMHWVKQKPGQGLEWIGYINPYNDGTKYNEKFKGKATLTSDKSSSTAYMELSSLTSEDSAVYYCARGTYYYGSRVFDYWGQGTTLTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5819 - protein, 1138 aa, Artificial Sequence
  Synthetic Polypeptide encoding a CAR with optional accessory module(s)
MALPVTALLLPLALLLHAARPEIVLTQSPDFQSVTPKEKVTITCRASESVDTFGISFMNWFQQKPDQSPKLLIHAASNQGSGVPSRFSGSGSGTDFTLTINSLEAEDAATYYCQQSKEVPFTFGGGTKVEIKGGGGSGGGGSGGGGSEVQLVESGGGLVQPGGSLRLSCAASGFTFSSSWMNWVRQAPGKGLEWVGRIYPGDGDTNYNGKFKGRFTISRDDSKNSLYLQMNSLKTEDTAVYYCARSGFITTVLDFDYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5820 - protein, 1134 aa, Artificial Sequence
  Synthetic Polypeptide encoding a CAR with optional accessory module(s)
MALPVTALLLPLALLLHAARPAIQLTQSPSSLSASVGDRVTITCRASQGISSAQQKPGKAPKLLILAWYSSLESGVPSRFSGYDASGSGTDFTLTISSLQPEDFATYYCQQFNSYPYTFGQGTKLEIKGGGGSGGGGSGGGGSEVQLVQSGAEVKKPGESLKISCKGSGYSFSSSWIGWVRQMPGKGLEWMGIIYPDDSDTRYSPSFQGQVTISADKSIRTAYLQWSSLKASDTAMYYCARHVTMIWGVIIDFWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5821 - protein, 1158 aa, Artificial Sequence
  Synthetic Polypeptide encoding a CAR with optional accessory module(s)
MALPVTALLLPLALLLHAARPINIYNAEPANPSEKNSPEFDIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIKGGGGSGGGGSGGGGSEVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5822 - protein, 1140 aa, Artificial Sequence
  Synthetic Polypeptide encoding a CAR with optional accessory module(s)
MALPVTALLLPLALLLHAARPDILLTQSPATLSLSPGERATLSCRASQSVDYDGDSYLNWYQQKPGQPPKLLIYDASNLVSGIPPRFSGSGSGTDFTLTISRLEPEDFAVYHCQQSTEDPWTFGGGTKLEIKGGGGSGGGGSGGGGSQVQLVESGGGLVEPGGSLRLSCMSGYAFSSYWMNWVRQMPGKGLEWMGQIWPGDGDTNYNPSLKSRVTITADESTSTAYMELSSLKAEDTAVYFCARRETTTVGRYYYAMDYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5823 - protein, 1137 aa, Artificial Sequence
  Synthetic Polypeptide encoding a CAR with optional accessory module(s)
MALPVTALLLPLALLLHAARPDILLTQSPATLSLSPGERATLSCRASQSVDNYGISFMNWYQQKPGQPPKLLIYAASNQGSGIPSRFSGSGSGTDFTLTISSLEPEDFAMYFCQQSNEVPRTFGGGTKLEIKGGGGSGGGGSGGGGSQVQLVESGGGLVEPGGSLRLSCMSGYAFSSSWMNWVRQMPGKGLEWMGRIYPGDGDTNYNGKFKERVTITADESTSTAYMELSSLKAEDTAVYFCARSEYWGNYWAMDYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5824 - protein, 1136 aa, Artificial Sequence
  Synthetic Polypeptide encoding a CAR with optional accessory module(s)
MALPVTALLLPLALLLHAARPDILLTQSPATLSLSPGERATLSCKASQNVGTNVAWYQQKPGQPPKLLIYSATYRNSGIPARFSGSGSGTEFTLTITNVQSKDLADYFYFCQYNRYPYTSGGGTKLEIKRGGGGSGGGGSGGGGSQVQLVESGGGLVEPGGSLRLSCMSGYAFSSYWMNWVRQMPGKGLEWMGQIYPGDGDTNYNGKFKGRVTITADESTSTAYMELSSLKAEDTAVYFCARKTISSVVDFYFDNWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5825 - protein, 1149 aa, Artificial Sequence
  Synthetic Polypeptide encoding a CAR with optional accessory module(s)
MALPVTALLLPLALLLHAARPINIYNAEPANPSEKNSPEFQIVLTQSPATLSASPGEKATMTCSASSGVNYMHWYQQKPGTSPKRWIYDTDKTASGVPARFSGSGSGTSYSLTISSMEAEDAATYYCHQRGSYTFGGGTKLEIKGGGGSGGGGSGGGGSQVQLEQPGAEVVKPGASVKVSCKTSGYTFTSNWMHWVKQTPGKGLEWIGEIDPSDSYTNYNQKFDGKAKLTVDKSSSTAYMEVSDLTAEDSATYYCARGSNPYYYAMDYWGQGTSVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5826 - protein, 1135 aa, Artificial Sequence
  Synthetic Polypeptide encoding a CAR with optional accessory module(s)
MALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRGGGGSGGGGSGGGGSQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5827 - protein, 1143 aa, Artificial Sequence
  Synthetic Polypeptide encoding a CAR with optional accessory module(s)
MALPVTALLLPLALLLHAARPDDIQLTQSPSSLSASVGDRVTITCKASQSVDYDGDSYLNWYQQIPGKAPKLLIYDASNLVSGIPPRFSGSGSGTDYTFTISSLQPEDIATYHCQQSTEDPWTFGGGTKLQIKRGGGGSGGGGSGGGGSQVQLQQSGAEVKKPGSSVKVSCKASGYAFSSYWMNWVRQRPGQGLEWIGQIWPGDGDTNYNGKFKGRATITADESTNTAYMELSSLRSEDTAFYSCARRETTTVGRYYYAMDYWGQGTTVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5828 - protein, 1134 aa, Artificial Sequence
  Synthetic Polypeptide encoding a CAR with optional accessory module(s)
MALPVTALLLPLALLLHAARPQSVLTQPASVSGSPGQSITISCTGTSSDVGGYNYVSWYQQHPGKAPKLMIYDVNNRPSEVSNRFSGSKSGNTASLTISGLQAEDEADYYCSSYTTGSRAVFGGGTKLTVLGGGGGSGGGGSGGGGSEVQLVQSGAEVKKPGESLTISCKASGYSFPNYWITWVRQMSGGGLEWMGRIDPGDSYTTYNPSFQGHVTISIDKSTNTAYLHWNSLKASDTAMYYCARYYVSLVDIWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5829 - protein, 1140 aa, Artificial Sequence
  Synthetic Polypeptide encoding a CAR with optional accessory module(s)
MALPVTALLLPLALLLHAARPQSVVTQPPSVSAAPGQKVTISCSGSSSNIGNNYVSWYQQLPGTAPKLLIYDNNKRPSGIPDRFSGSKSGTSATLGITGLQTGDEADYYCGTWDGSLYTMLFGGGTKLTVLGGGGSGGGGSGGGGSEVQLVESGGGLVKPGGSLRLSCAASGFTFSNAWMSWVRQAPGKGLEWVGFIRSKAYGGTTEYAASVKGRFTISRDDSKSIAYLQMNNLKTEDTAVYYCARDGLYSSSWYDSDYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5830 - protein, 1145 aa, Artificial Sequence
  Synthetic Polypeptide encoding a CAR with optional accessory module(s)
MALPVTALLLPLALLLHAARPQSVLTQPPSVSGAPGQRVTISCTGSSSNIGAGYDVHWYQQLPGTAPKLLIFGNSNRPSGVPDRFSGFKSGTSASLAITGLQAEDEADYFCQSYDSSLSGSGVFGTGTKVTVLGGGGGSGGGGSGGGGSQMQLVQSGGGLVQPGRSLRLSCAASGFTFDDYAMHWVRQAPGKGLEWVSGISWNSGSIGYADSVKGRFTISRDNAKNSLYLQMNSLRAEDTALYYCAKDIHSGSYYGLLYYAMDVWGQGTTVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5831 - protein, 1132 aa, Artificial Sequence
  Synthetic Polypeptide encoding a CAR with optional accessory module(s)
MALPVTALLLPLALLLHAARPDYIHVTQSPSSLSVSIGDRVTINCQTSQGVGSDLHWYQHKPGRAPKLLIHHASSVEDGVPSRFSGTGFHTSFNLTINDLQADDIGTYYCQVLQSFGRGSRLDTKGGGGSGGGGSGGGGSRAHLVQSGTAMKKPGASVRVSCQTSGYTFTAHILFWFRQAPGRGLEWVGWIKPQYGAVNFGGGFRDRVTLTRDVYREIAYMDIRGLKPDDTAVYYCARDRSYGDSSWALDAWGQGTTVVVSATRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5832 - protein, 1142 aa, Artificial Sequence
  Synthetic Polypeptide encoding a CAR with optional accessory module(s)
MALPVTALLLPLALLLHAARPDVQMIQTPDSLAVSLGQRATISCRASESVDNYGISFMHWYQQKPGQSPKLLIYRASNLESGIPARFSGSGSRTDFTLTINPVETDDVATYYCQQNNKDPPTFGGGTKLEIKGGGGSGGGGSGGGGSGGGGSQVQLQQSGAELVKPGASVKISCKASGYAFSSYWMNWVKQRPGKGLEWIGQIYPGDGDTTYNGKFKGKATLTADKSSSTVYMQLNSLTSEDSAVYFCVRYYYGSSGYFDYWGQGTTLTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5833 - protein, 1133 aa, Artificial Sequence
  Synthetic Polypeptide encoding a CAR with optional accessory module(s)
MALPVTALLLPLALLLHAARPDVQMIQTPSSLSASLGDRVTISCRASQDIGNYLNWYQQKPDGTVKLLIYYTSRLHSGVPSRFSGSGSGTEYSLTISNLEQEDIATYFCQQGSALPPTFGGGTKLEINGGGGSGGGGSGGGGSALQLQQSGAELVRPGASVTLSCKASGYTFTDYEMHWVKQTPVHGLEWIGAIDPETGGTAYNQKFEGKAILTADKSSSTAYMELRSLTSEDSPVYYCARRRYYGSSSFDYWGQGTTLTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5834 - protein, 1140 aa, Artificial Sequence
  Synthetic Polypeptide encoding a CAR with optional accessory module(s)
MRLPAQLLGLLMLWVSGSSGDVVMTQSPLSLPVTPGAPASISCRSSQSIVHSNGNTYLEWYLQKPGQSPKLLIYKVSNRFSGVPDRFSGSGSGTDFTLRISRVEAEDVGIYYCFQGSHVPPTFGPGTKLEIKGGGGSGGGGSGGGGSEVQLVESGGGLVQPGGSLRLSCSASGFTFSSFGMHWVRQAPGKGLEWVAYISSGSSTIYYGDTVKGRFTISRDNAKNSLFLQMSSLRAEDTAVYYCAREGGYYYGRSYYTMDYWGQGTTVTVSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5835 - protein, 1165 aa, Artificial Sequence
  Synthetic Polypeptide encoding a CAR with optional accessory module(s)
MALPVTALLLPLALLLHAARPARKRTQPTFGFTVNWKFSESTTVFTGQCFIDRNGKEVLKTMWLLRSSVNDIGDDWKATRVGINIFTRLRTQKEGGSGGSARKCSLTGKWTNDLGSNMTIGAVNSRGEFTGTYITAVTATSNEIKESPLHGTQNTINKSGGSTTVFTGQCFIDRNGKEVLKTMWLLRSSVNDIGDDWKATRVGINIFTRLRTQKEGGSGGSARKCSLTGKWTNDLGSNMTIGAVNSRGEFTGTYITAVTATSNEIKESPLHGTQNTINKRTQPTFGFTVNWKFSETRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5836 - protein, 1137 aa, Artificial Sequence
  Synthetic Polypeptide encoding a CAR with optional accessory module(s)
MALPVTALLLPLALLLHAARPDIVLTQSPASLAVSLGQRATISCRASKSVSTSGYSYLHWYQQKPGQPPKLLIYLASNLESGVPARFSGSGSGTDFTLNIHPVEEEDAATYYCQHSRELPFTFGSGTKLEIKGGGGSGGGGSGGGGSQVQLVESGGGLVQPGGSLKLSCAASGFDFSRYWMSWVRQAPGKGLEWIGEINPTSSTINFTPSLKDKVFISRDNAKNTLYLQMSKVRSEDTALYYCARGNYYRYGDAMDYWGQGTSVTVSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5837 - protein, 1135 aa, Artificial Sequence
  Synthetic Polypeptide encoding a CAR with optional accessory module(s)
MALPVTALLLPLALLLHAARPDIQMTQSPSSLSASVGDRVTITCSASQDISNYLNWYQQKPGKAPKLLIYYTSNLHSGVPSRFSGSGSGTDFTLTISSLQPEDFATYYCQQYRKLPWTFGQGTKLEIKRGGGGSGGGGSGGGGSQVQLVQSGAEVKKPGSSVKVSCKASGGTFSNYWMHWVRQAPGQGLEWMGATYRGHSDTYYNQKFKGRVTITADKSTSTAYMELSSLRSEDTAVYYCARGAIYDGYDVLDNWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5838 - protein, 1135 aa, Artificial Sequence
  Synthetic Polypeptide encoding a CAR with optional accessory module(s)
MALPVTALLLPLALLLHAARPDIVLTQSPATLSLSPGDRATISCRASESVTILGSHLIYWYQQKPGQPPRLLIQLASNVQTGVPARFSGSGSRTDFTLTISSVEPEDFAVYYCLQSRTIPRTFGQGTKLEIKRGGGGSGGGGSGGGGSQVQLVQSGPEVKKPGESVKISCKASGYTFRHYSMNWVKQAPGQGLKWMGRINTESGVPIYADDFKGRFSFTVDTSASTAYLEISSLTSEDTAVYFCSNDYLYSLDFWGQGTTLTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5839 - protein, 1136 aa, Artificial Sequence
  Synthetic Polypeptide encoding a CAR with optional accessory module(s)
MALPVTALLLPLALLLHAARPQSVLTQPPSVSGAPGQRVTISCTGSSSNIGAGFDVHWYQQLPGTAPKLLIYGNSNRPSGVPDRFSGSKSGTSASLAITGLQAEDEADYYCQSYDSSLSGYVFGTGTKVTVLGGGGGSGGGGSGGGGSQVQLVQSGAEVKKPGASVKVSCKASGYTFTDYYMHWVRQAPGQRLEWMGWINPNSGGTNYAQKFQDRITVTRDTSSNTGYMELTRLRSDDTAVYYCARSPYSGVLDKWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5840 - protein, 1134 aa, Artificial Sequence
  Synthetic Polypeptide encoding a CAR with optional accessory module(s)
MALPVTALLLPLALLLHAARPQAVLTQPPSASGTPGQRVTISCSGSSSNIGSYTVSWYQQLPGTAPKFLIYSNNQRPSGVPDRFSGSKSGTSASLAISGLQSEDEADYYCAAWDDSLNGYVFGTGTKVTVLGGGGGSGGGGSGGGGSEVQLVQSGAEVKKPGESLKISCKGSGYDFTTYWIGWVRQMPGKGLEWMGIIYPGDSDTRYSPSVRGRVTISADKSINTAYLQWSSLEASDTAMYYCARMWTFSQDGWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5841 - protein, 1145 aa, Artificial Sequence
  Synthetic Polypeptide encoding a CAR with optional accessory module(s)
MALPVTALLLPLALLLHAARPLPVLTQPPSASGTPGQRVTISCSGRSSNIGSNSVNWYRQLPGAAPKLLIYSNNQRPPGVPVRFSGSKSGTSASLAISGLQSEDEATYYCATWDDNLNVHYVFGTGTKVTVLGSRGGGGSGGGGSGGGGSLEMAQVQLVQSGAEVKKPGSSVKVSCKASGGTFSSYAISWVRQAPGQGLEWMGRIIPILGIANYAQKFQGRVTITADKSTSTAYMELSSLRSEDTAVYYCARGGYYSHDMWSEDWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5842 - protein, 1134 aa, Artificial Sequence
  Synthetic Polypeptide encoding a CAR with optional accessory module(s)
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRIFPRTFGQGTKLEIKGGGGSGGGGSGGGGSQVQLVQSGSELKKPGESVKISCKASGYTFTDYSINWVKQAPGQGLKWMGWINTETREPAYAYDFRGRFVFSLDTSASTAYLQISSLKAEDTAVYFCALDYSYAMDYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5843 - protein, 1135 aa, Artificial Sequence
  Synthetic Polypeptide encoding a CAR with optional accessory module(s)
MALPVTALLLPLALLLHAARPDIVLTQSPATLSLSPGDRATLSCRASESVTILGSHLIYWYQQKPGQAPRLLIQLASNVQTGIPARFSGSGSRTDFTLTISSLEPEDFAVYYCLQSRTIPRTFGQGTKLEIKRGGGGSGGGGSGGGGSQVQLVQSGSELKKPGESVKISCKASGYTFTHYSMNWVRQAPGQGLEWMGRINTETGEPLYADDFKGRFVFSLDTSASTAYLQISSLKAEDTAVYYCSNDYLYSLDYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5844 - protein, 1136 aa, Artificial Sequence
  Synthetic Polypeptide encoding a CAR with optional accessory module(s)
MALPVTALLLPLALLLHAARPDIVMTQSPDSLAVSLGERATINCKSSQSILYSSNQKNYLAWYQQKPGQSPKLLIYWASTRESGVPDRFSGSGSGTDFTLTISSLQAEDVAVYYCHQYISSYTFGQGTKLEIKGGGGSGGGGSGGGGSQVQLVQSGAEVKKPGASVKVSCKASGYTFASQWMHWMRQAPGQGLEWIGWINPGNVNTKYNEKFKGRATLTVDTSTNTAYMELSSLRSEDTAVYYCARSTWYRPLDYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5845 - protein, 1260 aa, Artificial Sequence
  Synthetic Polypeptide encoding a CAR with optional accessory module(s)
MVRGVPFRHLLLVLQLALLPAATQGKKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASGGGGSGGGGSGGGGSIYQELTQLKAAVERLCHPCPWEWTFFQGNCYFMSNSQRNWHDSITACKEVGAQLVVIKSAEEQNFLQLQSSRSNRFTWMGLSDLNQEGTWQWVDGSPLLPSFKQYWNRGEPNNVGEEDCAEFSGNGWNDDKCNLAKFWICKKSAASCSRDEEQFLSPAPATPNPPPATRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5846 - protein, 1136 aa, Artificial Sequence
  Synthetic Polypeptide encoding a CAR with optional accessory module(s)
MALPVTALLLPLALLLHAARPDHIVLTQSPSSLSASLGDRVTISCRASQDISTYLNWYQQKPDGTVKLLIFYTSRLHAGVPSRFSGSGSGTHHSLTISNLEQEDIATYFCQQGNSLPFTFGSGTKLEIKRGGGGSGGGGSGGGGSQVQLKESGPELEKPGASVKISCKASGYSFTAYSMNWVKQNNGMSLEWIGSIDPYYGDTKYAQKFKGKATLTVDKASSTAYLQLKSLTSEDSAVYYCARRMITTGDWYFDVWGAGTTVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5847 - protein, 1136 aa, Artificial Sequence; identical to SEQ ID NO: 5846
  Synthetic Polypeptide encoding a CAR with optional accessory module(s)

SEQ ID NO: 5848 - protein, 1083 aa, Artificial Sequence
  Synthetic Polypeptide encoding a CAR with optional accessory module(s)
MALPVTALLLPLALLLHAARPGMRTEDLPKAVVFLEPQWYRVLEKDSVTLKCQGAYSPEDNSTQWFHNESLISSQASSYFIDAATVDDSGEYRCQTNLSTLSDPVQLEVHIGWLLLQAPRWVFKEEDPIHLRCHSWKNTALHKVTYLQNGKGRKYFHHNSDFYIPKATLKDSGSYFCRGLVGSKNVSSETVNITITQGLAVSTISSFFPPGYQTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5849 - protein, 1083 aa, Artificial Sequence; identical to SEQ ID NO: 5848
  Synthetic Polypeptide encoding a CAR with optional accessory module(s)

SEQ ID NO: 5850 - protein, 1136 aa, Artificial Sequence
  Synthetic Polypeptide encoding a CAR with optional accessory module(s)
MALPVTALLLPLALLLHAARPDEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKGGGGSGGGGSGGGGSEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5851 - protein, 1138 aa, Artificial Sequence
  Synthetic Polypeptide encoding a CAR with optional accessory module(s)
MALPVTALLLPLALLLHAARPDIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKRGGGGSGGGGSGGGGSQVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5852 - protein, 1135 aa, Artificial Sequence
  Synthetic Polypeptide encoding a CAR with optional accessory module(s)
MALPVTALLLPLALLLHAARPDIVLTQSPAIITASPGEKVTMTCRASSSVNYMDWYQKKPGSSPKPWIYATSNLASGVPSRFSGSGSGTTYSMTISSLEAEDAATYYCQQWSFNPPTFGGGTKLEIKRGGGGSGGGGSGGGGSEVQLQQSGAELKKPGASVKVSCKASGYTFTSYNMHWVKQTPGQGLEWIGAIYPGNGDTSYNQKFKGKTTLTADKSSSTAYMELSSLRSEDTAVYYCARSNYYGSSYWFFDVWGTGTTVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5853 - protein, 1138 aa, Artificial Sequence
  Synthetic Polypeptide encoding a CAR with optional accessory module(s)
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSDWPLTFGGGTKVEIKGGGGSGGGGSGGGGSEVQLVQSGGGLVHPGGSLRLSCTGSGFTFSYHAMHWVRQAPGKGLEWVSIIGTGGVTYYADSVKGRFTISRDNVKNSLYLQMNSLRAEDMAVYYCARDYYGAGSFYDGLYGMDVWGQGTTVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5854 - protein, 1136 aa, Artificial Sequence
  Synthetic Polypeptide encoding a CAR with optional accessory module(s)
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGGGTKVEIKGGGGSGGGGSGGGGSAVQLVESGGGLVQPGRSLRLSCAASGFTFGDYTMHWVRQAPGKGLEWVSGISWNSGSIGYADSVKGRFTISRDNAKNSLYLQMNSLRAEDTALYYCTKDNQYGSGSTYGLGVWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5855 - protein, 1135 aa, Artificial Sequence
  Synthetic Polypeptide encoding a CAR with optional accessory module(s)
MALPVTALLLPLALLLHAARPDIQMTQSPSSLSASVGDRVTITCRASSSVSYMHWYQQKPGKAPKPLIYAPSNLASGVPSRFSGSGSGTDFTLTISSLQPEDFATYYCQQWSFNPPTFGQGTKVEIKRGGGGSGGGGSGGGGSEVQLVESGGGLVQPGGSLRLSCAASGYTFTSYNMHWVRQAPGKGLEWVGAIYPGNGDTSYNQKFKGRFTISVDKSKNTLYLQMNSLRAEDTAVYYCARVVYYSNSYWYFDVWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5856 - protein, 1133 aa, Artificial Sequence
  Synthetic Polypeptide encoding a CAR with optional accessory module(s)
MALPVTALLLPLALLLHAARPDIQLTQSPSSLSASVGDRVTMTCRASSSVSYIHWFQQKPGKAPKPWIYATSNLASGVPVRFSGSGSGTDYTFTISSLQPEDIATYYCQQWTSNPPTFGGGTKLEIKGGGGSGGGGSGGGGSQVQLQQSGAEVKKPGSSVKVSCKASGYTFTSYNMHWVKQAPGQGLEWIGAIYPGNGDTSYNQKFKGKATLTADESTNTAYMELSSLRSEDTAFYYCARSTYYGGDWYFDVWGQGTTVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5857 - protein, 1145 aa, Artificial Sequence
  Synthetic Polypeptide encoding a CAR with optional accessory module(s)
MALPVTALLLPLALLLHAARPSTVMTQSPDSLAVSLGERATINCKSSQSNSNDVAWYQQKPGQSPKVLIYFASNRYSGVPDRFSGSGYGTDFTLTISSLQAEDVAVYFCQQDYSSPLTFGAGTKLELKRADAGGGGSGGGGSGGGGSQIQLVQSGSELKKPGASVKVSCKASGYTFTNFGVNWVRQAPGKGLEWMGWINTYTGEPSYAQGFTGRFVFSLDASVSTAYLQISSLKAEDTATYFCTRRTNYYGTSYYYAMDYWGQGTTVTVSSAKTTTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5858 - protein, 1137 aa, Artificial Sequence
  Synthetic Polypeptide encoding a CAR with optional accessory module(s)
MALPVTALLLPLALLLHAARPQIVLSQSPAILSASPGEKVTMTCRASSSVSYMHWYQQKPGSSPKPWIYATSNLASGVPARFSGSGSGTSYSFTISRVEAEDAATYYCQQWTFNPPTFGGGTRLEIKRTVAAGGGGSGGGGSGGGGSQAYLQQSGAELVRPGASVKMSCKASGYTFTSYNMHWVKQTPRQGLEWIGGIYPGNGDTSYNQKFKGKATLTVGKSSSTAYMQLSSLTSEDSAVYFCARYDYNYAMDYWGQGTSVTVSSASTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5859 - protein, 1135 aa, Artificial Sequence; identical to SEQ ID NO: 5855
  Synthetic Polypeptide encoding a CAR with optional accessory module(s)

SEQ ID NO: 5860 - protein, 1134 aa, Artificial Sequence
  Synthetic Polypeptide encoding a CAR with optional accessory module(s)
MALPVTALLLPLALLLHAARPEIVLTQSPSSLSASVGDRVTITCRASSSLSFMHWYQQKPGKAPKPWIYATSNLASGVPSRFSGSGSGTDYTLTISSLQPEDFATYFCHQWSSNPLTFGGGTKVEIKGGGGSGGGGSGGGGSQVQLVQSGAEVKKPGASVKVSCKASGYTFTSYNMHWVRQAPGQRLEWIGAIYPGNGDTSYNQKFKGRVTVTRDTSANTAYMELSSLKSEDTAVYYCARSHYGSNYVDYFDYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5861 - protein, 1136 aa, Artificial Sequence
  Synthetic Polypeptide encoding a CAR with optional accessory module(s)
MALPVTALLLPLALLLHAARPDEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKGGGGSGGGGSGGGGSEVQLVESGGGLVQPDRSLRLSCAASGFTFHDYAMHWVRQAPGKGLEWVSTISWNSGTIGYADSVKGRFTISRDNAKNSLYLQMNSLRAEDTALYYCAKDIQYGNYYYGMDVWGQGTTVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5862 - protein, 1134 aa, Artificial Sequence
  Synthetic Polypeptide encoding a CAR with optional accessory module(s)
MALPVTALLLPLALLLHAARPEIVLTQSPGTLSLSPGERATLSCRASSSVPYIHWYQQKPGQAPRLLIYATSALASGIPDRFSGSGSGTDFTLTISRLEPEDFAVYYCQQWLSNPPTFGQGTKLELKRGGGGSGGGGSGGGGSEVQLVQSGAEVKKPGESLKLSCKGSGRTFTSYNMHWVRQMPGKGLEWMGAIYPLTGDTSYNQKSKLQVTISADKSISTAYLQWSSLKASDTAMYYCARSTYVGGDWQFDVWGKGTTVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5863 - protein, 1139 aa, Artificial Sequence
  Synthetic Polypeptide encoding a CAR with optional accessory module(s)
MALPVTALLLPLALLLHAARPDIQMTQSPSSLSASVGDRVTITCRSSQSIVHSVGNTFLEWYQQKPGKAPKLLIYKVSNRFSGVPSRFSGSGSGTDFTLTISSLQPEDFATYYCFQGSQFPYTFGQGTKVEIKRGGGGSGGGGSGGGGSEVQLVESGGGLVQPGGSLRLSCAASGYEFSRSWMNWVRQAPGKGLEWVGRIYPGDGDTNYSGKFKGRFTISADTSKNTAYLQMNSLRAEDTAVYYCARDGSSWDWYFDVWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5864 - protein, 1131 aa, Artificial Sequence
  Synthetic Polypeptide encoding a CAR with optional accessory module(s)
MALPVTALLLPLALLLHAARPDIVMTQSPSSLSASVGDRVTITCKASQSVTNDVAWYQQKPGKAPKLLIYYASNRYTGVPSRFSGSGSGTDFTLTISSLQPEDFATYYCQQDYRSPWTFGGGTKVEIKRGGGGSGGGGSGGGGSQVQLEESGGGVVRPGRSLRLSCAASGFTFSDYGVNWIRQAPGKGLEWVTIIWGDGRTDYNSALKSRFTVSRNNSNNTLSLQMNSLTTEDTAVYYCVRAPGNRAMEYWGQGVLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5865 - protein, 1137 aa, Artificial Sequence
  Synthetic Polypeptide encoding a CAR with optional accessory module(s)
MALPVTALLLPLALLLHAARPDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQIFGQGTKLEIKGGGGSGGGGSGGGGSQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5866 - protein, 1137 aa, Artificial Sequence
  Synthetic Polypeptide encoding a CAR with optional accessory module(s)
MALPVTALLLPLALLLHAARPQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSGGGGSGGGGSGGGGSDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQIFGQGTKLEIKTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5867 - protein, 1130 aa, Artificial Sequence
  Synthetic Polypeptide encoding a CAR with optional accessory module(s)
MALPVTALLLPLALLLHAARPDIQMTQSPATIENTSLSASVGDRVTITCRASQGISSWLTWYQQKPEKAPKSLIYAASSLQSGVPSRFSGSGSGTDFTLTISSLQPEDFATYYCQQYDSYPITFGQGTRLEIKGGGGSGGGGSGGGGSQVQLQQWGAGLLKPSETLSLTCAVYGGSFSAYYWSWIRQPPGKGLEWIGDINHGGGTNYNPSLKSRVTISVDTSKNQFSLKLNSVTAADTAVYYCASLTAYWGQGSLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5868 - protein, 1135 aa, Artificial Sequence
  Synthetic Polypeptide encoding a CAR with optional accessory module(s)
MALPVTALLLPLALLLHAARPDEIVLTQSPDSLAVSLGERATINCKASQSVDFDGDSYLNWYQQKPGQPPKVLIYAASTLQSGVPSRFSGSGSGTDFTLTINSLEAEDAATYYCQQSNEDPWTFGGGTKVEIKGGGGSGGGGSGGGGSQVQLVQSGAEVKKPGASVKVSCKVSGYTFTDYYITWVRQAPGQALEWMGWIYPGSGNTKYSQKFQGRFVFSVDTSASTAYLQLSSLKAEDTAVYYCANYGNYWFAYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5869 - protein, 1132 aa, Artificial Sequence
  Synthetic Polypeptide encoding a CAR with optional accessory module(s)
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKGGGGSGGGGSGGGGSEVQLVQSGGGLVHPGGSLRLSCAGSGFAFSSSTMHWIRQAPGKGLEWISLIGSGGGIYYGDSVKGRFTISRDNAKNSLYLQMNSLRAEDMAVYYCVRGYFDWVDYFDYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5870 - protein, 1142 aa, Artificial Sequence
  Synthetic Polypeptide encoding a CAR with optional accessory module(s)
MALPVTALLLPLALLLHAARPDDIVMTQSPDSLTVSLGERTTINCKSSQSVLDSSKNKNSLAWYQQKPGQPPKLLLSWASTRESGIPDRFSGSGSGTDFTLTIDSLQPEDSATYYCQQSAHFPITFGQGTRLEIKGGGGSGGGGSGGGGSQVQLVQSGAEVKKPGASVKVSCKASGYTFTNYGMNWVKQAPGQGLKWMGWINTYTGEPTYADDFKGRVTMTSDTSTSTAYLELHNLRSDDTAVYYCARWSWSDGYYVYFDYWGQGTTVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5871 - protein, 1138 aa, Artificial Sequence
  Synthetic Polypeptide encoding a CAR with optional accessory module(s)
MALPVTALLLPLALLLHAARPDEIVLTQSPGSLAVSPGERVTMSCKSSQSVFFSSSQKNYLAWYQQIPGQSPRLLIYWASTRESGVPDRFTGSGSGTDFTLTISSVQPEDLAIYYCHQYLSSRTFGQGTKLEIKRGGGGSGGGGSGGGGSQVQLQQPGAEVVKPGASVKMSCKASGYTFTSYYIHWIKQTPGQGLEWVGVIYPGNDDISYNQKFQGKATLTADKSSTTAYMQLSSLTSEDSAVYYCAREVRLRYFDVWGQGTTVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5872 - protein, 1164 aa, Artificial Sequence
  Synthetic Polypeptide encoding a CAR with optional accessory module(s)
MALPVTALLLPLALLLHAARPYINIYNAEPANPSEKNSPTQYAYGSGEFDIQLTQSPSSLSASVGDRVTITCRASQGISSVLAWYQQKPGKAPKLLIYDASSLESGVPSRFSGSGSGTDFTLTISSLQPEDFATYYCQQFNSSITFGQGTKLEIKRTVAAGGGGSGGGGSGGGGSQVQLVQSGAEVKKPGSSVKVSCKASGGTFSDYAISWVRQAPGQGLEWMGRIIPILGVANYAQKFQGRVTITADKSTRTAYMELSSLRSEDTAVYYCARNWADAFDIWGQGTMVTVSSASTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5873 - protein, 1163 aa, Artificial Sequence
  Synthetic Polypeptide encoding a CAR with optional accessory module(s)
MALPVTALLLPLALLLHAARPYINIYNAEPANPSEKNSPTQYAYGSGEFDIVMTQSPSSLSASLGGKVTITCKASQDINKYIAWYQHKPGKGPRLLIHYTSTLQPGIPSRFSGSGSGRDYSFSISNLEPEDIATYYCLQYDNLLTFGAGTKLELKRGGGGSGGGGSGGGGSEVKLQQSGPELVKPGTSVKVSCKASGYSFTDYNMYWVKQSHGKSLEWIGYIDPYKGGTIYNQKFKGKATLTVDKSSSTAFMHLNSLTSEDSAVYYCAREMITAYYFDYWGQGSSVTVSSLERTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5874 - protein, 1179 aa, Artificial Sequence
  Synthetic Polypeptide encoding a CAR with optional accessory module(s)
MALPVTALLLPLALLLHAARPDIQMTQSPSSLSASVGDRVTINCKASQDINSYLSWFQQKPGKAPKTLIYRANRLVDGVPSRFSGSGSGQDYTLTISSLQPEDFATYYCLQYDEFPLTFGGGTKVEIKGGGGSGGGGSGGGGSQVQLVQSGAEVKKPGASVKVSCKASGYTFTNYDINWVRQAPGQGLEWIGWIYPGDGSTKYNEKFKAKATLTADTSTSTAYMELRSLRSDDTAVYYCASGYEDAMDYWGQGTTVTVSSAKPTTTPAPRPPTPAPTIASQPLSLRPEACRPAAGGAVHTRGLDFACDITRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5875 - protein, 1135 aa, Artificial Sequence
  Synthetic Polypeptide encoding a CAR with optional accessory module(s)
MALPVTALLLPLALLLHAARPEIVLTQSPLSLPVTPGEPASISCRSSQSLLHSNGYNYLDWYLQKPGQSPQLLIYLGVNSVSGVPDRFSGSGSGTDFTLKISRVEAEDVGVYYCMQALQTPWTFGQGTKVEIKGGGGSGGGGSGGGGSQVQLVQSGAEVKKPGSSVKVSCKASGGIFSNHAISWVRQAPGQGLEWMGGIIPIFGTANYAQKFQGRVTITADESTSTAFMELSSLRSEDTAVYYCAREWADVFDIWGQGTMVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5876 - protein, 1134 aa, Artificial Sequence
  Synthetic Polypeptide encoding a CAR with optional accessory module(s)
MALPVTALLLPLALLLHAARPDIQMTQSPASLTVSLGQRATISCRASESVDSYGNSYLHWYQQKPGQPPQLLIYLASNLESGVPARFSGSGSRTDFTLTIDPVEADDAATYYCQQNNEDPWTFGGGTKVEIKGGGGSGGGGSGGGGSEVQLQQSGAELVKPGASVKMSCKAFGYTFTTFPIEWMKQSHGKSLEWIGNFHPYNDQTKYNEEFKGRAKLTIDRSSSTVYLELGRLTSDDSAVYYCARGYYYAFDFWGQGTTLTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5877 - protein, 1131 aa, Artificial Sequence
  Synthetic Polypeptide encoding a CAR with optional accessory module(s)
MALPVTALLLPLALLLHAARPDIQMTQSPSSLSASVGDRVTITCRASQGIRNDLGWYQQKPGKAPKRLIYAASSLQSGVPSRFSGSGSGTEFTLTISSLQPEDFATYYCLQHNSYPWTFGQGTKLEIKGGGGSGGGGSGGGGSEVQLVESGGALIQPGGSLRLSCVASGFTISGNYMSWVRQAPGKGLEWVSLIYSGDSTYYADSVKGRFTISRDISKNTVYLQMNSLRVEDTAVYYCVRDGYYVSDMVVWGKGTTVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5878 - protein, 1141 aa, Artificial Sequence
  Synthetic Polypeptide encoding a CAR with optional accessory module(s)
MALPVTALLLPLALLLHAARPDVLLTQSPLSLPVTLGQPASISCRSSQTIVHSNGNTYLEWFQQRPGQSPRLLIYQVSNRFSGVPDRFSGSGSGTDFTLKISRVEAEDVGVYYCFQGSHVPRTFGGGTKVEIKRGGGGSGGGGSGGGGSQIQLVQSGSELKKPGASVKVSCKASGYTFTNYGMNWVRQAPGQGLKWMGWINTNTGEPKYAEEFKGRFALSLDTSVSTAYLQINSLKAEDTAVYFCARGYGNYARGAWLAYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5879 - protein, 1128 aa, Artificial Sequence
  Synthetic Polypeptide encoding a CAR with optional accessory module(s)
MALPVTALLLPLALLLHAARPDEIVLTQSPATLSLSPGERATLSCSASSSINYIYWLQQKPGQAPRILIYLTSNLASGVPARFSGSGSGTDFTLTISSLEPEDFAVYYCLQWSSNPLTFGGGTKVEIKGGGGSGGGGSGGGGSFEVQLVESGGGLVKPGGSLRLSCAASGFTFSSYDMSWVRQAPGKGLEWVSTISSGGSYTYYLDSIKGRFTISRDNAKNSLYLQMNSLRAEDTAVYYCARQGLDYWGRGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5880 - protein, 1136 aa, Artificial Sequence
  Synthetic Polypeptide encoding a CAR with optional accessory module(s)
MALPVTALLLPLALLLHAARPDIVMTQSPDSLAVSLGERATINCRASKSVSTSGYSFMHWYQQKPGQPPKLLIYLASNLESGVPDRFSGSGSGTDFTLTISSLQAEDVAVYYCQHSREVPWTFGQGTKVEIKRGGGGSGGGGSGGGGSQVQLVQSGAEVKKPGASVKVSCKASGYTFTNYGMNWVRQAPGQGLEWMGWINTYTGEPTYADAFKGRFAFSLDTSTSTAYLQINSLRSDDTAVYYCARDYGDYGMDYWGQGTTVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5881 - protein, 1132 aa, Artificial Sequence
  Synthetic Polypeptide encoding a CAR with optional accessory module(s)
MALPVTALLLPLALLLHAARPDIVMTQTPLTLSVTIGQPASISCKSSQSLLDSDGKTYLNWLLQRPGQSPERLIYLVSKLDSGVPDRFTGSGSGTDFTLKISRVEAEDLGVYCCWQGTHFPYTFGGGTKVEIKGGGGGSGGGGSGGGGSQVQLQQPGAELVRPGASVKLSCKASGYTFTSYWMNWVKQRPGQGLEWIGMIDPSDSETHYNHIFKDKATLTVDKSSSTAYLQLSSLTSEDSAVYYCARNLYLWGQGTSVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5882 - protein, 1136 aa, Artificial Sequence
  Synthetic Polypeptide encoding a CAR with optional accessory module(s)
MALPVTALLLPLALLLHAARPDDIQLTQSPSSLSASVGDRVTITCKASQSVDYEGDSFLNWYQQKPGKAPKLLIYAASNLESGVPSRFSGSGSGTDFTLTISSLQPEDFATYYCQQSNEDPLTFGQGTKVEIKRGGGGSGGGGSGGGGSEVQLVESGGGLVQPGGSLRLSCAASGYTFSSYWIEWVRQAPGKGLEWIGEILPGGGDTNYNEIFKGRATFSADTSKNTAYLQMNSLRAEDTAVYYCTRRVPIRLDYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5883 - protein, 1132 aa, Artificial Sequence
  Synthetic Polypeptide encoding a CAR with optional accessory module(s)
MALPVTALLLPLALLLHAARPDIVMTQTPLSLSVTPGQPASISCKSSQSLLDGDGKTYLNWLLQKPGQSPQRLIYLVSKLDSGVPDRFSGSGSGTDFTLKISRVEAEDVGVYYCWQGTHFPRTFGQGTKLEIKGGGGSGGGGSGGGGSQVQLVQSGAEVKKPGASVKVSCKASGYTFKDTYIHWVRQAPGQGLEWMGRIDPANGNTKYDPKFQGRVTMTRDTSISTAYMELSRLRSDDTAVYYCARRGGVDWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5884 - protein, 1140 aa, Artificial Sequence
  Synthetic Polypeptide encoding a CAR with optional accessory module(s)
MALPVTALLLPLALLLHAARPDIVMTQSPDSLAVSLGERATINCESSQSLLNSGNQKNYLTWYQQKPGQPPKPLIYWASTRESGVPDRFSGSGSGTDFTLTISSLQAEDVAVYYCQNDYSYPYTFGQGTKLEIKRGGGGSGGGGSGGGGSEVQLVQSGAEVKKPGESLKISCKGSGYSFTDYYMKWARQMPGKGLEWMGDIIPSNGATFYNQKFKGQVTISADKSISTTYLQWSSLKASDTAMYYCARSHLLRASWFAYWGQGTMVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5885 - protein, 1135 aa, Artificial Sequence
  Synthetic Polypeptide encoding a CAR with optional accessory module(s)
MALPVTALLLPLALLLHAARPDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKGGGGSGGGGSGGGGSQIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5886 - protein, 1139 aa, Artificial Sequence
  Synthetic Polypeptide encoding a CAR with optional accessory module(s)
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKGGGGSGGGGSGGGGSEVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5887 - protein, 1139 aa, Artificial Sequence
  Synthetic Polypeptide encoding a CAR with optional accessory module(s)
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKGGGGSGGGGSGGGGSQVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5888 - protein, 1133 aa, Artificial Sequence
  Synthetic Polypeptide encoding a CAR with optional accessory module(s)
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQDYGFPWTFGQGTKVEIKRGGGGSGGGGSGGGGSEVQLVQSGAEVKKPGESLKISCKGSGYSFTSYWISWVRQMPGKGLEWMGIIDPSDSDTRYSPSFQGQVTISADKSISTAYLQWSSLKASDTAMYYCARGDGSTDLDYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5889 - protein, 1135 aa, Artificial Sequence
  Synthetic Polypeptide encoding a CAR with optional accessory module(s)
MALPVTALLLPLALLLHAARPQFVLTQPPSVSTNPGSTVKLSCKRNTGNIGSNYVNWYQQKPGQSPTTMIYRDDKRPDGVPDRFSGSIDRSSNSALLTINNVQTEDEADYFCQSYSSGINIIFGGGTKLTVLGGGGSGGGGSGGGGSQVQLQESGPGLVKPSETLSLTCTVSGFSLTTYDVHWVRQPPGKGLEWMGRIQNAGITDYNSALKSRLIISRDTSKSQVFLKMNSVTTADTAMYFCAKTGSYFYAFDHWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5890 - protein, 1132 aa, Artificial Sequence
  Synthetic Polypeptide encoding a CAR with optional accessory module(s)
MALPVTALLLPLALLLHAARPDIQMTQSPASLSASLGETVTIECRPSEDIHSNVAWYQQKPGNSPQLLIYDASNLADGVPSRFSGSGSGTQYSLKINSLQSEDVASYFCHQYNIYPYTFGSGTKLELKGGGGSGGGGSGGGGSQVQLQESGPTLVKPGDSVKMSCKASGYTFTDYIIHWVKQSHGKSLEWIGYINPYSDGTNYNEKFKSKATLTVDKSTSTAYMEFSRLTSEDSAIYFCALNYGSYYAMDAWGQGTSVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5891 - protein, 1133 aa, Artificial Sequence
  Synthetic Polypeptide encoding a CAR with optional accessory module(s)
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGQGTKVEIKRGGGGSGGGGSGGGGSEVQLLESGGGLVQPGGSLRLSCAASGFTFSGYWMHWVRQAPGKGLEWVSAIRSDGSSKYYADSVKGRFTISRDNSKNTLYLQMNSLRAEDTAVYYCAKDGVIEDTFDYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5892 - protein, 1129 aa, Artificial Sequence
  Synthetic Polypeptide encoding a CAR with optional accessory module(s)
MALPVTALLLPLALLLHAARPDVQITQSPSYLAASPGETITINCRASKSISKDLAWYQEKPGKTNKLLIYSGSTLQSGIPSRFSGSGSGTDFTLTISSLEPEDFAMYYCQQHNKYPYTFGGGTKLEIKRGGGGSGGGGSGGGGSQVQLQQPGAELVRPGASVKLSCKASGYTFTSYWMNWVKQRPDQGLEWIGRIDPYDSETHYNQKFKDKAILTVDKSSSTAYMQLSSLTSEDSAVYYCARGNWDDYWGQGTTLTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5893 - protein, 1160 aa, Artificial Sequence
  Synthetic Polypeptide encoding a CAR with optional accessory module(s)
MALPVTALLLPLALLLHAARPYINIYNAEPANPSEKNSPTQYAYGSGEFDIQMTQSPASLSASLGETVTIECRTSKDIYSNLAWFQQEPGNSPQLLIYDASNLADGVPSRFSGSGSGTQYSLQINNLQSEDVASYFCHQYNNYPYTFGTGTKLELKGGGGSGGGGSGGGGSQVQLQESGPTLVNPGDSVKMSCKASGYTFTDHIIHWVKQSHGKSLEWIGYINPYSGGANYNGKFKSKATLTIDKSSSTAYMEFSRLTSGDSAIYYCALNYGSYYAMDAWGQGTSVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5894 - protein, 1131 aa, Artificial Sequence
  Synthetic Polypeptide encoding a CAR with optional accessory module(s)
MALPVTALLLPLALLLHAARPEIVLTQSPTSMTASPGEQVTITCRASSSINYMHWYQQKPGASPRPWIYETSKLASGVPDRFSGSASGTSYSLTINNMEAEDAATYYCQQWNYPSWTFGGGTKLELKGGGGSGGGGSGGGGSEVQLVESGGGLVQPGRSLKLSCAASGFTFSDYNMAWVRQAPKKGLEWVATILYDGGRTYYRGSVKGRFTISRDNAKSTLYLRMDSLRSEDTATYYCATHSRGTDYFDYWGQGVMVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5895 - protein, 1140 aa, Artificial Sequence
  Synthetic Polypeptide encoding a CAR with optional accessory module(s)
MALPVTALLLPLALLLHAARPDIVMTQSPSSLAVSEGETVTINCKSSQSFLSSGDGKNYVAWYQYKPGQSPKLLIYWASTRQSGVPDRFIGSGSGTDFTLTISTVQAEDLAIYYCQQYYDTPLTFGSGTKLEIKGGGGSGGGGSGGGGSEVKLQESGPSLVQSSQTLSLTCTVSGFSLTSYHIHWVRQTPGKGLEWMGVMWSDGDTSYNSALKSRLSISRDTSQSQVFLKMNSLQTEDTATYYCARGYYSSYLYLWFAYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5896 - protein, 1144 aa, Artificial Sequence
  Synthetic Polypeptide encoding a CAR with optional accessory module(s)
MALPVTALLLPLALLLHAARPDVLMTQTPVSLPVSLGGQVSISCRSSQSLVHSDGDTYLHWYLQKPGQSPQLLIYRVSNRFSGVPDRFSGSGSGTDFTLKISRVEPEDLGLYYCLQTTHFPPWTFGGGTKLEMKGGGGSGGGGSGGGGSQVQLQQSGPELRRPGSSVRLSCKASGYRIKDFLIHWIKNRPEHGLEWIGWIDPEDGETKYAQKFQTKATLTADTSSNTAYMQLSSLTSEDTATYFCARWGDVYYGLMRGHVMDAWGQGTSVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5897 - protein, 1135 aa, Artificial Sequence
  Synthetic Polypeptide encoding a CAR with optional accessory module(s)
MALPVTALLLPLALLLHAARPDIQMTQSTSSLSASLGDRVTISCSASQGINNYLNWYQQKPDGTVELLIYYTSTLQSGVPSRFSGSGSGTDYSLTISNLEPEDIGTYYCQQYSKLPRTFGGGTKLEIKGGGGSGGGGSGGGGSQVQLQQSGSELMMPGASVKISCKATGYTFSNYWIEWVKQRPGHGLEWIGEILPGTGRTIYNEKFKGKATFTADISSNTVQMQLSSLTSEDSAVYYCARRDYYGNFYYAMDYWGQGTSVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5898 - protein, 1130 aa, Artificial Sequence
  Synthetic Polypeptide encoding a CAR with optional accessory module(s)
MALPVTALLLPLALLLHAARPDIQMTQSPASLSVSVGETVTITCRASENIYSNLAWYQQKQGKSPQLLVYAATNLADGVPSRFSGSGSGTQYSLKINSLQSEDFGSYYCQHFWGTWTFGGGTTLEIKGGGGSGGGGSGGGGSEVQLQQSGPELVKPGASVKMSCKASGYTFTDYYMKWMKQSHGKSLEWIGDINPNNGGTTYNQKFKGKATLTVDKSSSTAYMQLNSLTSEDSAVYYCARDYGYGYFDYWGQGTTLTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5899 - protein, 1133 aa, Artificial Sequence
  Synthetic Polypeptide encoding a CAR with optional accessory module(s)
MALPVTALLLPLALLLHAARPEIVLTQSPGTLSLSPGERATLSCRASQSVGGYLAWYQQKPGQAPRLLIYDASNRATGIPARFSGSGSGTDFTLTISSLEPEDFAVYYCQQRNNWPPMYTFGQGTKLEIKRGGGGSGGGGSGGGGSQVQLVQSGAEVKKPGSSVKVSCKASGGTFSSYAISWVRQAPGQGLEWMGGIIPILGTANYAQKFQGRVTITADESTSTAYMELSSLRSEDTAVYYCARWGGGAFDIWGQGTMVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5900 - protein, 1128 aa, Artificial Sequence
  Synthetic Polypeptide encoding a CAR with optional accessory module(s)
MALPVTALLLPLALLLHAARPQIVLTQSPALMSASPGEKVTMTCSASSSVRYMYWYQQKPRSSPKPWIHLTSNLASGVPARFSGSGSGTSYSLTISSMEAEDAATYYCQQWSSHPFTFGSGTKLEIKGGGGSGGGGSGGGGSDVQLQESGPGLVKPSQSLSLTCTVTGFSITSDYSWNWIRQFPGNKLEWMGYISYSGHTSYNPSLESRISITRDTSKNQFFLQLNSVTTEDTATYYCTRGNWDVVYWGQGTLVTVSATRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5901 - protein, 1138 aa, Artificial Sequence
  Synthetic Polypeptide encoding a CAR with optional accessory module(s)
MALPVTALLLPLALLLHAARPDVVMTQSPLSLPVTLGQPASISCRSSQSIVHSDGNTYLEWYQQRPGQSPRRLIYKVSNRFSGVPDRFSGSGSGTDFTLKISRVEAEDVGVYYCFQGSHAPWTFGGGTKVEIKGGGGSGGGGSGGGGSEVQLVESGGGLVQPGGSLRLSCAASGFTFSSYGMHWVRQAPGKGLEWVAYITTRSSTIYYADSVKGRFTISRDNAKNSLYLQMNSLRAEDTAVYYCTREPLTGYYAMDYWGQGTSVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5902 - protein, 1130 aa, Artificial Sequence
  Synthetic Polypeptide encoding a CAR with optional accessory module(s)
MALPVTALLLPLALLLHAARPDIQMTQSPSSLSASVGDRVTITCRASQSISLWLNWYQQKPGKAPKLLIYAASTLQSGVPSRFSGSGSGTDFTLTISSLQPEDFATYYCQQYYTSPYTFGQGTKVEIKRGGGGSGGGGSGGGGSQVQLLESGGGLVQPGGSLRLSCAASGFTFSSYAMSWVRQAPGKGLEWVSVIRSSGSSTYYADSVKGRFTISRDNSKNTLYLQMNSLRAEDTAVYYCARGGGYFDYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5903 - protein, 1133 aa, Artificial Sequence
  Synthetic Polypeptide encoding a CAR with optional accessory module(s)
MALPVTALLLPLALLLHAARPDIQMTQSPSSLSASVGDRVTITCRASQSISSYLNWYQQKPGKAPKLLIYAVSTLQSGVPSRFSGSGSGTDFTLTISSLQPEDFATYYCQQSGTFPPTTFGQGTKVEIKRGGGGSGGGGSGGGGSQVQLLESGGGLVQPGGSLRLSCAASGFTFSSHGMHWVRQAPGKGLEWVSVISGSGSNTGYADSVKGRFTISRDNSKNTLYLQMNSLRAEDTAVYYCARQWGSYAFDSWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5904 - protein, 1143 aa, Artificial Sequence
  Synthetic Polypeptide encoding a CAR with optional accessory module(s)
MALPVTALLLPLALLLHAARPDIVMSQSPSSLAVSVGEKVTMSCKSSQSLLHSSNQKNYLAWYQQKPGQSPKVLIYWASTRESGVPDRFTGSGSGTDFTLTITSVKSEDLAVYYCQQYYSYPWTFGGGTRLEIKRGGGGSGGGGSGGGGSEVQLQQSVAELVKPGASVKMSCKVSGYTLTDHTIHWMKQRPEQGLEWIGYIYPRDGITGYNEKFKGKATLTADTSSSTAYMQLNSLTSEDSAVYFCARWGYSYRNYAYYYDYWGQGTTLTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5905 - protein, 1140 aa, Artificial Sequence
  Synthetic Polypeptide encoding a CAR with optional accessory module(s)
MALPVTALLLPLALLLHAARPEIVLTQSPGTLSLSPGERATLSCRASQSVSSSYLAWYQQKPGQAPRLLIYGTSSRATGIPDRFSGSGSGTDFTLTISRLEPEDFAVYYCQQYGSSPFTFGGGTKVEIKRGGGGSGGGGSGGGGSQVQLQESGPGLAKPSETLSLTCTVSGDSITSYYWSWIRQPPGKGLEWIGYIYYSGSTNYNPSLKSRVTISVDTSKNQFSLKLSSVTAADTAVYYCARDQRRIAAAGTHFYGMDVWGQGTTVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5906 - protein, 1132 aa, Artificial Sequence
  Synthetic Polypeptide encoding a CAR with optional accessory module(s)
MALPVTALLLPLALLLHAARPDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKGGGGSGGGGSGGGGSQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSATRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5907 - protein, 1125 aa, Artificial Sequence
  Synthetic Polypeptide encoding a CAR with optional accessory module(s)
MALPVTALLLPLALLLHAARPMTQSPKFLLVSAGDRVTLTCKASQSVNNDVYWYQQEPGQSPKLLIYWASTRESGVPDRFTGSGSGTDFTLTISSVQAEDLAVYYCKQSYNLYTFGGGTKLEIKRGGGGSGGGGSGGGGSESGRGLVQPGGSRKLSCAASGFTFSTSGMHWVRQAPEKGLEWVAYISSGSTTIYHADTVKGRFTISRDNPKNTLFLQMTSLRSEDTAMYYCCARSGQFGNYFDYWGQGTTLTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5908 - protein, 1130 aa, Artificial Sequence
  Synthetic Polypeptide encoding a CAR with optional accessory module(s)
MALPVTALLLPLALLLHAARPQSPSSLAVSAGEKVTMSCKSSQSLLNSRTRKNYLAWYQQKPGQSPKLLIYWASTRESGVPDRFTGSGSGTDFTLTISSVQAEDLAVYYCKQSNLYTFGGGTKLEIKGGGGSGGGGSGGGGSQVQLEESGPELVKPGASVKLSCKASGYTFTEYIIHWVKQRSGQGLEWIGWFYPGSGSIKYNEKFKDKATLTADKSSSTVYMELSGLTSEDSAVYFCARHDGYSYFDYWGQGTTLTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5909 - protein, 1142 aa, Artificial Sequence
  Synthetic Polypeptide encoding a CAR with optional accessory module(s)
MEMFQGLLLLLLLSMGGTWASREMLRPRCRPINATLAVEKEGCPVCITVNTTICAGYCPTMTRVLQGVLPALPQVVCNYRDVRFESIRLPGCPRGVNPVVSYAVALSCQCALCRRSTTDCGGPKDHPLTCDDPRFQASSSSKAPPPSLPSPSRLPGPSDTPILPQGGGGSGGGGSGGGGSAPDVQDCPECTLQENPFFSQPGAPILQCMGCCFSRAYPTPLRSKKTMLVQKNVTSESTCCVAKSYNRVTVMGGFKVENHTACHCSTCYYHKSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5910 - protein, 1133 aa, Artificial Sequence
  Synthetic Polypeptide encoding a CAR with optional accessory module(s)
MALPVTALLLPLALLLHAARPDIQMTQSPSSLSASLGERVSLTCRATQELSGYLSWLQQKPDGTIKRLIYAASTLDSGVPKRFSGNRSGSDYSLTISSLESEDFADYYCLQYAIYPYTFGGGTKLEIKGGGGSGGGGSGGGGSEVQLQQSGPELVKPGASVKMSCKASGYTFTSYFIHWVKQKPGQGLEWIGFINPYNDGSKYNEKFKGKATLTSDKSSSTAYMELSSLTSEDSAVYYCTRDDGYYGYAMDYWGQGTSVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5911 - protein, 1138 aa, Artificial Sequence
  Synthetic Polypeptide encoding a CAR with optional accessory module(s)
MALPVTALLLPLALLLHAARPDTIVLTQSPASLAVSLGQRATISCRASESVDSYGNSFMHWYQQKPGQPPKLLIYLASNLESGVPARFSGSGSRTDFTLTIDPVEADDAATYYCQQNNYDPWTFGGGTKLEIKGGGGSGGGGSGGGGSEVQLQQSGPELVKPGASVKMSCKASGYTFTSYVMHWVKQKPGQGLEWIGYINPYNDGTKYNEKFKGKATLTSDTSSSTAYMELNSLTSEDSAVYFCARPIYFDNDYFDYWGQGTTLKVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5912 - protein, 1133 aa, Artificial Sequence
  Synthetic Polypeptide encoding a CAR with optional accessory module(s)
MALPVTALLLPLALLLHAARPDIQMTQSPSSLSASVGDRVTITCKASQDVSTAVAWFQQKPGKAPKLLIYSPSYRYTGVPSRFSGSGSGTDFTLTISSLQPEDFTYYCQQLYSTPYTFGQGTKVEIKGGGGSGGGGSGGGGSEVQLVQSGAEVKKPGASVKVSCKASGYTFTDYYLDVVVRQAPGQGLEWIGRVNPYNGGTIYNQKFKGRVTLTRDTSTSTAYLELSSLRSEDTAVYYCARDHYRYDPLLDYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5913 - protein, 1139 aa, Artificial Sequence
  Synthetic Polypeptide encoding a CAR with optional accessory module(s)
MALPVTALLLPLALLLHAARPDIQMTQSPSSLSASVGDRVTITCRASQSVSTSSYNYMHWYQQKPGKPPKLLIKYASNLESGVPSRFSGSGSGTDFTLTISSLQPEDFATYYCQHSWEIPLTFGQGTKVEIKGGGGSGGGGSGGGGSEVQLVQSGAEVKKPGASVKVSCKASGYSFTDYYMHWVRQAPGQGLEWIGRINPYNGAAFYSQNFKDRVTLTVDTSTSTAYLELSSLRSEDTAVYYCAIERGADLEGYAMDYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5914 - protein, 1137 aa, Artificial Sequence
  Synthetic Polypeptide encoding a CAR with optional accessory module(s)
MALPVTALLLPLALLLHAARPEIVLTQSPATLSASPGERVTLTCRASSNVISSYVHWYQQKPGSSPRLFLYSTSNLASGVPSRFSGSGSGTDFTFTISSLEAEDAATYYCQQYSGYPLTFGQGTRLEIKGGGGSGGGGSGGGGSQVQLQESGPGLVKPSETLSLTCAVSGYSITSAYYWNWIRQPPGKGLEWIGYISYDGRNNYNPSLKNRITINPDTSKNQFSLQLNSVTPEDTAVYYCAREGDYDVGNYYAMDYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5915 - protein, 1137 aa, Artificial Sequence
  Synthetic Polypeptide encoding a CAR with optional accessory module(s)
MALPVTALLLPLALLLHAARPEIVLTQSPATLSLSPGERATLSCRASSNVISSYVHWYQQKPGQAPRLLIYSTSNLASGIPARFSGSGSGTDFTLTISSLEPEDFAVYYCQQYSGYPLTFGQGTRLEIKGGGGSGGGGSGGGGSEVQLVESGGGLVQPGRSLRLSCAASGYSITSAYYWNWVRQAPGKGLEWVSYISYDGRNNYNPSLKNRFTISRDNAKKSLYLQMNSLRAEDTALYYCAKEGDYDVGNYYAMDYWGQGTTVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5916 - protein, 1149 aa, Artificial Sequence
  Synthetic Polypeptide encoding a CAR with optional accessory module(s)
MALPVTALLLPLALLLHAARPDLNFMLTQPHSVSGSPGKTVTISCTRSTGSITSNYVHWYQQRPGSSPTTVICEDNERPSGVPDRFSGSIDISSNSASLTISGLKTEDEADYYCQSYDDSNHISVFGTGTKVTVLGQPKANPGGGGSGGGGSGGGGSQVQLQESGPGLVKPSETLSLTCTVSGGSISSSNYYWGWIRQPPGKGLEWIGAIYYSGSTYYNPSLKSRVAISVDTSKNQFSLKLSSVTAADTAVYYCARRIGVAGQWYFDLWGRGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5917 - protein, 1135 aa, Artificial Sequence
  Synthetic Polypeptide encoding a CAR with optional accessory module(s)
MALPVTALLLPLALLLHAARPDIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIKGGGGSGGGGSGGGGSQIQLVQSGPDLKKPGETVKISCKASGYTFTNTGMNWVKQAPGKGLKWMGWINTYTGEPTYADDFKGRFTFSLETSASTAYLQINNLKNEDTATYFCTRWGYGSSLYYAMDYWGQGTSVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5918 - protein, 1132 aa, Artificial Sequence
  Synthetic Polypeptide encoding a CAR with optional accessory module(s)
MALPVTALLLPLALLLHAARPDIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIKGGGGSGGGGSGGGGSEVQLVESGGGLVQPGGSLRLSCAASGFDFSRYWMSWVRQAPGKGLEWIGEINPDSSTINYAPSLKDKFIISRDNAKNSLYLQMNSLRAEDTAVYYCARPDGNYWYFDVWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5919 - protein, 1133 aa, Artificial Sequence
  Synthetic Polypeptide encoding a CAR with optional accessory module(s)
MALPVTALLLPLALLLHAARPDIVMTQSQKSMSTSVGDRVSITCKASQDVITGVAWYQQKPGQSPKLLIYSASYRYTGVPDRFTGSGSGTDFTFTISNVQAEDLAVYYCQQHYSTPLTFGAGTKLELKGGGGSGGGGSGGGGSQVQLQQPGAELVRPGASVKLSCKASGYSFTTYWMNWVKQRPGQGLEWIGMIHPSDSETRLNQKFKDKATLTVDKSSSTAYMQLSSPTSEDSAVYYCARSTMIATRAMDYWGQGTSVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5920 - protein, 1135 aa, Artificial Sequence
  Synthetic Polypeptide encoding a CAR with optional accessory module(s)
MALPVTALLLPLALLLHAARPDIQMTQSPSSLSASVGDRVTITCKASQDVSTAVAWYQQKPGKAPKLLIYSASYRYTGVPDRFTGSGSGTDFTLTISSLQPEDFATYYCQQHYSTPPYTFGGGTKVEIKRGGGGSGGGGSGGGGSQVQLVQSGAEVKKPGASVKVSCKASGYAFSSSWMNWVRQAPGQGLEWIGRIYPGDGDTKYNGKFKGKATLTADKSTSTAYMELSSLRSEDTAVYYCARSTMIATGAMDYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5921 - protein, 1136 aa, Artificial Sequence
  Synthetic Polypeptide encoding a CAR with optional accessory module(s)
MALPVTALLLPLALLLHAARPDVVMTQTPLSLSVTPGQPASISCRSSQSLVHNNGNTYLHWYLQKPGQSPQLLIYKVSNRFSGVPDRFSGSGSGTDFTLKISRVEAEDVGVYFCSQSTHVPPYTFGGGTKVEIKGGGGSGGGGSGGGGSEVQLVESGGGLVQPGGSLRLSCAASGFTFSDYYMAWVRQAPGKGLEWVAEINYDGSSTYYVDSVKGRFTISRDNAKNSLYLQMNSLRAEDTAVYYCARDRGFYFDYWGQGTTVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5922 - protein, 1136 aa, Artificial Sequence
  Synthetic Polypeptide encoding a CAR with optional accessory module(s)
MALPVTALLLPLALLLHAARPDVVMTQTPLSLSVTPGQPASISCRSSQSLVHSNGLTYLHWYLQKPGQSPQLLIYKVSNRFSGVPDRFSGSGSGTDFTLKISRVEAEDVGVYFCSQSTHVPPFTFGGGTKVEIKGGGGSGGGGSGGGGSEVQLVESGGGLVQPGGSLRLSCAASGFTFSDYYMAWVRQAPGKGLEWVASINYDGESTYYVDSVKGRFTISRDNAKNSLYLQMNSLRAEDTAVYYCARDRGYYFDYWGQGTTVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5923 - protein, 1136 aa, Artificial Sequence
  Synthetic Polypeptide encoding a CAR with optional accessory module(s)
MALPVTALLLPLALLLHAARPDVVMTQSPLSLPVTPGEPASISCRSSQSLVHSNGNTYLHWYLQKPGQSPQLLIYKVSNRFSGVPDRFSGSGSGTDFTLKISRVEAEDVGVYFCSQSTHVPPFTFGGGTKVEIKGGGGSGGGGSGGGGSEVQLVESGGGLVQPGGSLRLSCAASGFTFSDYYMAWVRQAPGKGLEWVADINYDGGSTYYLDSLKSRFTISRDNAKNSLYLQMNSLRAEDTAVYYCARDRGYYFDYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5924 - protein, 1134 aa, Artificial Sequence
  Synthetic Polypeptide encoding a CAR with optional accessory module(s)
MALPVTALLLPLALLLHAARPDIQMTQSSSYLSVSLGGRVTITCKASDHINNWLAWYQQKPGNAPRLLISGATSLETGVPSRFSGSGSGKDYTLSITSLQTEDVATYYCQQYWSTPWTFGGGTKLEIKGGGGSGGGGSGGGGSQVQLQQSGAELARPGASVKLSCKASGYTFTSYWMQWVKQRPGQGLEWIGAIYPGDGDTRYTQKFKGKATLTADKSSSTAYMQLSSLASEDSAVYYCARGKVYYGSNPFAYWGQGTLVTVSATRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5925 - protein, 1134 aa, Artificial Sequence
  Synthetic Polypeptide encoding a CAR with optional accessory module(s)
MALPVTALLLPLALLLHAARPDIVMTQSHKFMSTSVGDRVSITCKASQDVSTAVAWYQQKPGQSPKLLIYSASYRYTGVPDRFTGSGSGTDFTFTISSVQAEDLAVYYCQQHYSTPPYTFGGGTKLEIKGGGGSGGGGSGGGGSQVQLQQSGPELVKPGASVKISCKASGYAFSSSWMNWVKQRPGQGLEWIGRIYPGDGDTKYNGKFKGKATLTADKSSSTAYMQLSSLTSVDSAVYFCARSTMIATGAMDYWGQGTSVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5926 - protein, 1139 aa, Artificial Sequence
  Synthetic Polypeptide encoding a CAR with optional accessory module(s)
MALPVTALLLPLALLLHAARPQSVLTQPPSVSGAPGQRVTISCTGSGSNIGAPYDVSWYQQLPGTAPKLLIYHNNKRPSGVPDRFSGSKSGTSASLAITGLQAEDEADYYCATVEAGLSGSVFGGGTKLTVLGAGGGGSGGGGSGGGGSQVQLVQSGAEVKKPGASVKVSCKVSGYTLTELSIHWVRQAPGKGLEWMGGFDPEENEIVYAQRFQGRVTMTEDTSTDTAYMELSSLRSEDTAVYYCAIVGSFSPLTLGLWGQGTMVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5927 - protein, 1139 aa, Artificial Sequence
  Synthetic Polypeptide encoding a CAR with optional accessory module(s)
MALPVTALLLPLALLLHAARPQSVLTQPPSVSGAPGQRVTISCTGSGSNIGAPYDVSWYQQLPGTAPKLLIYHNNKRPSGVPDRFSGSKSGTSASLAITGLQAEDEADYYCQSYDSSSISTIFGGGTKLTVLGAGGGGSGGGGSGGGGSQVQLVQSGAEVKKPGASVKVSCKVSGYTLTELSIHWVRQAPGKGLEWMGGFDPEENEIVYAQRFQGRVTMTEDTSTDTAYMELSSLRSEDTAVYYCAIVGSFSGIAYRPWGQGTMVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5928 - protein, 1150 aa, Artificial Sequence
  Synthetic Polypeptide encoding a CAR with optional accessory module(s)
MALPVTALLLPLALLLHAARPDEFEVQLVESGGGLVQAGGSLRLSCVASGISSSKRNMGWYRQAPGKQRESVATISSGGNKDYTDAVKDRFTISRDTTKNTVYLQMNSLKPEDTAVYYCKIEAGTGWATRRGYTYWGQGTLVTVSSLEGGGGSGGGGSGGGGSFEVQLVESGGGLVQAGGSLRLSCAASGSIFSGNVMGWYRRQAPGKEREWVAAIASGGSIYYRDSVKGRFTISRDNAKNTVYLQMNSLKPEDTAVYYCNSHPPTLPYWGLGTQVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5929 - protein, 1184 aa, Artificial Sequence
  Synthetic Polypeptide encoding a CAR with optional accessory module(s)
MALPVTALLLPLALLLHAARPDEFEVQLVESGGGLVQAGDSLRLSCAASGRAFSRYAMGWFRQAPGKEREFVAAIGWGPSKTNYADSVKGRFTISRDNAKNTVYLQMNTLKPEDTAVYSCAAKFVNTDSTWSRSEMYTYWGQGTLVTVSSLEGGGGSGGGGSGGGGSGSGGSGSGGSGSGGSGSGGSFEVQLVESGGGSVQAGGSLRLSCTTSGRALNMYVMGWFRQAPGNEREFVAATSSSGGSTSYPDSVKGRFTISRDNAKNTVYLQMNSLKPEDTAAYRCAASPYVSTPTMNILEEYRYWGLGTQVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5930 - protein, 1137 aa, Artificial Sequence
  Synthetic Polypeptide encoding a CAR with optional accessory module(s)
MALPVTALLLPLALLLHAARPDIQMTQSPSSLSASVGDRVTITCSASSSVSYMYWYQQKPGKAPKLLIYLTSNLASGVPSRFSGSGSGTDFTLTISSLQPEDFATYYCQQWRSNPFTFGQGTKLEIKRGGGGSGGGGSGGGGSQITLKESGPTLVKPTQTLTLTCTFSGFSLSTSGMGVGWIRQPPGKALEWLAHIWWDDVKRYSPSLKSRLTITKDTSKNQVVLTMTNMDPVDTATYYCARIVSFDNDVVSAMDYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5931 - protein, 1132 aa, Artificial Sequence
  Synthetic Polypeptide encoding a CAR with optional accessory module(s)
MALPVTALLLPLALLLHAARPEIVMTQSPATLSVSPGERATLSCKASQSVSNDVVWYQQKPGQAPRLLIYYASNRYTGIPARFSGSGSGTEFTLTISSLQSEDFAVYYCQQDYTSPWTFGQGTKLEIKRGGGGSGGGGSGGGGSQVQLVQSGAEVKKPGASVKVSCKASGYTFTNYGMNWVRQAPGQGLEWMGWINTYTGEPTYADDFKGRVTMTTDTSTSTAYMELRSLRSDDTAVYYCARIGDSSPSDYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5932 - protein, 1133 aa, Artificial Sequence
  Synthetic Polypeptide encoding a CAR with optional accessory module(s)
MALPVTALLLPLALLLHAARPDSTDIQMTQSPSSLSASVGDRVTITCRASQSISSYLNWYQQKPGKAPKLLIYLASNLQSGVPSRFSGSGSGTDFTLTISSLQPEDFATYYCQQAEYMPLTFGQGTKVEIKRAGGGGSGGGGSGGGGSEVQLLESGGGLVQPGGSLRLSCAASGFTFSGYAMSWVRQAPGKGLEWVSEIAPPGLNTRYADSVKGRFTISRDNSKNTLYLQMNSLRAEDTAVYYCAKSDTAFDYWGQGTLVTVSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5933 - protein, 1136 aa, Artificial Sequence
  Synthetic Polypeptide encoding a CAR with optional accessory module(s)
MALPVTALLLPLALLLHAARPDQAVLTQESALTTSPGETVTLTCRSSTGAVTTSNYANWVQEKPDHLFTGLIGGTNNRVPGVPARFSGSLIGDKAALTITGAQTEDEAIYFCVLWHSNHWVFGGGTKLTVLGGGGSGGGGSGGGGSDVQLVESGGGLVQPGGSRKLSCAASGFTFSSFGMHWVRQAPEKGLEWVAYISSGSSTLHYADTVKGRFTISRDNPKNTLFLQMTSLRSEDTAMYYCARWGNYPHYAMDYWGQGTSVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5934 - protein, 1018 aa, Artificial Sequence
  Synthetic Polypeptide encoding a CAR with optional accessory module(s)
MALPVTALLLPLALLLHAARPDEFEVQLVESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5935 - protein, 1160 aa, Artificial Sequence
  Synthetic Polypeptide encoding a CAR with optional accessory module(s)
MALPVTALLLPLALLLHAARPDEFEVQLVESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTLVTVSSLEGGGGSGGGGSGGGGSFEEVQLVESGGGSVQAGGSLRLSCAASGDTYGSYWMGWFRQAPGKEREGVAAINRGGGYTVYADSVKGRFTISRDTAKNTVYLQMNSLRPDDTADYYCAASGVLGGLHEDWFNYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5936 - protein, 1179 aa, Artificial Sequence
  Synthetic Polypeptide encoding a CAR with optional accessory module(s)
MALPVTALLLPLALLLHAARPDEFEVQLVESGGGSVQAGGSLRLTCAASGSTSRSYGMGWFRQAPGKEREFVSGISWRGDSTGYADSVKGRFTISRDNAKNTVDLQMNSLKPEDTAIYYCAAAAGSTWYGTLYEYDYWGQGTLVTVSSLEGGGGSGGGGSGGGGSGSGGSGSGGSGSGGSGSGGSFEVQLVESGGGSVQAGGSLRLSCAASGDTYGSYWMGWFRQAPGQEREAVAAINRGGGYTVYADSVKGRFTISRDNAKNTLYLQMNSLRPDDTADYYCAASGVLGGLHEDWFNYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5937 - protein, 1127 aa, Artificial Sequence
  Synthetic Polypeptide encoding a CAR with optional accessory module(s)
MALPVTALLLPLALLLHAARPDIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVEGGGGSGGGGSGGGGSEVQVLESGGGLVQPGGSLRLSCAASGFTFSSYAMSWVRQAPGKGLEWVSAISGSGGSTNYADSVKGRFTISRDNSKNTLYLQMNSLRAEDTAVYYCAGSSGWSEYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5938 - protein, 1133 aa, Artificial Sequence
  Synthetic Polypeptide encoding a CAR with optional accessory module(s)
MALPVTALLLPLALLLHAARPDEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSGGGGSGGGGSGGGGSDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5939 - protein, 1140 aa, Artificial Sequence
  Synthetic Polypeptide encoding a CAR with optional accessory module(s)
MALPVTALLLPLALLLHAARPDELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGGGGSGGGGSGGGGSEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5940 - protein, 1141 aa, Artificial Sequence
  Synthetic Polypeptide encoding a CAR with optional accessory module(s)
MALPVTALLLPLALLLHAARPDELQMTQSPSSLSASVGDRVTITCRASQSISSYLNWYQQKPGQPPKLLIYWASTRESGVPDRFSGSESGTNYTLTISSLQPEDFATYFCQQSDSLPITFGQGTRLDIQGGGGSGGGGSGGGGSEVQLLESGGGVVQPGRSLRLSCAASGFTFSSYGMHWVRQAPGKGLEWVAVISYDGSNKYYADSVKGRFTISRDNSKNTLYLQMNSLRAEDTAVYYCAKDMGWGSGWRPYYYYGMDVWGQGTTVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5941 - protein, 1138 aa, Artificial Sequence
  Synthetic Polypeptide encoding a CAR with optional accessory module(s)
MALPVTALLLPLALLLHAARPDDIQMTQSPSSLSASVGDRVTITCRASQSISSYLNWYQQKPGKAPKLLIYAASSLQSGVPSRFSGSGSGTDFTLTISSLQPEDLATYYCQQSYSTPFTFGPGTKVDIKGGGGSGGGGSGGGGSVHEVQLVQSGAEVKKPGSSVKVSCKASGGTFSSYAISWVRQAPGQGLEWMGGIIPIFGTANYAQKFQGRVTITADKSTSTAYMELSSLRSEDTAVYYCATFALFGFREQAFDIWGQGTTVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5942 - protein, 1135 aa, Artificial Sequence
  Synthetic Polypeptide encoding a CAR with optional accessory module(s)
MALPVTALLLPLALLLHAARPDVVMTQTPLSLPVSLGDQASISCRSSQSLVHSNGNTYLRWYLQKPGQSPKVLIYKVSNRFSGVPDRFSGSGSGTDFTLKISRVEAEDLGVYFCSQSTHVPWTFGGGTKLEIKGGGGSGGGGSGGGGSEVKLDETGGGLVQPGRPMKLSCVASGFTFSDYWMNWVRQSPEKGLEWVAQIRNKPYNYETYYSDSVKGRFTISRDDSKSSVYLQMNNLRVEDMGIYYCTGSYYGMDYWGQGTSVTVSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5943 - protein, 1146 aa, Artificial Sequence
  Synthetic Polypeptide encoding a CAR with optional accessory module(s)
MALPVTALLLPLALLLHAARPDVVMTQTPLSLPVSLGDQASISCRSSQSLVHSNGNTYLRWYLQKPGQSPKVLIYKVSNRVSGVPDRFSGSGSGTDFTLKINRVEAEDLGVYFCSQSTHVPWTFGGGTKLEIKSSADDAKKDAAKKDDAKKDDAKKDGGVKLDETGGGLVQPGGAMKLSCVTSGFTFGHYWMNWVRQSPEKGLEWVAQFRNKPYNYETYYSDSVKGRFTISRDDSKSSVYLQMNNLRVEDTGIYYCTGASYGMEYLGQGTSVTVSTTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5944 - protein, 1142 aa, Artificial Sequence
  Synthetic Polypeptide encoding a CAR with optional accessory module(s)
MALPVTALLLPLALLLHAARPQVQLVESGGNLVQPGGSLRLSCAASGFTFGSFSMSWVRQAPGGGLEWVAGLSARSSLTHYADSVKGRFTISRDNAKNSVYLQMNSLRVEDTAVYYCARRSYDSSGYWGHFYSYMDVWGQGTLVTVSGGGGSGGGGSGGGGSSVLTQPSSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLGTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5945 - protein, 1137 aa, Artificial Sequence
  Synthetic Polypeptide encoding a CAR with optional accessory module(s)
MALPVTALLLPLALLLHAARPDIQMTQSPSSLSASVGDRVTITCRTSQSLSSYTHWYQQKPGKAPKLLIYAASSRGSGVPSRFSGSGSGTDFTLTISSLQPEDFATYYCQQSRTFGQGTKVEIKGGGGSGGGGSGGGGSQVQLQQSGPGLVKPSQTLSLTCAISGDSVSSYNAVWNWIRQSPSRGLEWLGRTYYRSGWYNDYAESVKSRITINPDTSKNQFSLQLNSVTPEDTAVYYCARSGHITVFGVNVDAFDMWGQGTMVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5946 - protein, 1136 aa, Artificial Sequence
  Synthetic Polypeptide encoding a CAR with optional accessory module(s)
MALPVTALLLPLALLLHAARPDIVLTQSPLSLAVSLGQPAIISCKASQSVSFAGTSLMHWYHQKPGQQPRLLIYRASNLEAGVPDRFSGSGSKTDFTLTISPVEAEDAATYYCQQSREYPYTFGGGTKLEIKRGGGGSGGGGSGGGGSQVQLVQSGAEVVKPGASVKISCKASGYTFTGYFMNWVKQSPGQSLEWIGRIHPYDGDTFYNQKFQGKATLTVDKSSNTAHMELLSLTSEDFAVYYCTRYDGSRAMDYWGQGTTVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5947 - protein, 1109 aa, Artificial Sequence
  Synthetic Polypeptide encoding a CAR with optional accessory module(s)
MALPVTALLLPLALLLHAARPNSCELTNITIAIEKEECRFCISINTTWCAGYCYTRDLVYKDPARPKIQKTCTFKELVYETVRVPGCAHHADSLYTYPVATQCHCGKCDSDSTDCTVRGLGPSYCSFGEMKEGGGGSGGGGSGGGGSAPDVQDCPECTLQENPFFSQPGAPILQCMGCCFSRAYPTPLRSKKTMLVQKNVTSESTCCVAKSYNRVTVMGGFKVENHTACHCSTCYYHKSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5948 - protein, 1140 aa, Artificial Sequence
  Synthetic Polypeptide encoding a CAR with optional accessory module(s)
MALPVTALLLPLALLLHAARPDLETTLTQSPATLSVSPGERVTLSCRASQSVGSNLAWYQQKFGQAPRLLIYDASTRATGIPARFSGSGSGTEFTLTISRLEPEDFAVYYCHQYGSSPRTFGQGTKVDIKRGGGGSGGGGSGGGGSQVQLVQSGAEVKKPGASVKVSCKASGYTFTTYGISWVRQAPGQGLEWMGWISAYNGHTNYAQMLQGRVTMTTDTSTSTAYMELRGLRSDDTAVYYCAREAYASYGSGSYWTDYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5949 - protein, 1133 aa, Artificial Sequence
  Synthetic Polypeptide encoding a CAR with optional accessory module(s)
MALPVTALLLPLALLLHAARPDDVVMTQTPLSLPVTPGEPASISCRSSQSLVHRNGNTYLHWYLQKPGQSPKLLIHKVSNRFSGVPDRFSGSGSGTDFTLKISRVEAEDLGVYFCSQSTHVPPLTFGAGTKLELKGGGGSGGGGSGGGGSEVQLVQSGAEVEKPGASVKISCKASGSSFTGYNMNWVRQNIGKSLEWIGAIDPYYGGTSYNQKFKGRATLTVDKSTSTAYMHLKSLRSEDTAVYYCVSGMEYWGQGTSVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5950 - protein, 1131 aa, Artificial Sequence
  Synthetic Polypeptide encoding a CAR with optional accessory module(s)
MALPVTALLLPLALLLHAARPDEIVMTQTPATLSVSAGERVTITCKASQSVSNDVTWYQQKPGQAPRLLIYSASNRYSGVPARFSGSGYGTEFTFTISSVQSEDFAVYFCQQDYSSFGQGTKLEIKRGGGGSGGGGSGGGGSQVQLVESGPGVVQPGRSLRISCAVSGFSVTNYGVHWVRQPPGKGLEWLGVIWAGGITNYNSAFMSRLTISKDNSKNTVYLQMNSLRAEDTAMYYCASRGGHYGYALDYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5951 - protein, 1133 aa, Artificial Sequence
  Synthetic Polypeptide encoding a CAR with optional accessory module(s)
MALPVTALLLPLALLLHAARPDIQMTQTASSLPASLGDRVTISCSASQDISNYLNWYQQKPDGTVKLLIFYSSNLHSGVPSRFSGGGSGTDYSLTISNLEPEDIATYFCHQYSKLPWTFGGGTKLEIKRGGGGSGGGGSGGGGSEVTLVESGGDFVKPGGSLKVSCAASGFAFSHYAMSWVRQTPAKRLEWVAYISSGGSGTYYSDSVKGRFTISRDNAKNTLYLQMRSLRSEDSAMYFCTRVKLGTYYFDSWGQGTTLTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5952 - protein, 1135 aa, Artificial Sequence
  Synthetic Polypeptide encoding a CAR with optional accessory module(s)
MALPVTALLLPLALLLHAARPQFVLTQSPSASAALGASAKLTCTLSSAHKTYTIDWYQQQKGKAPRYLIQVKSDGTYTKATGVPDRFSGSSSGADRYLIIPSVQADDEADYYCGTDYTGGYVFGGGTQLTVTGGGGSGGGGSGGGGSEQLKESGGGLFKPTDTLTLTCTVSGFSLSYYGVNWVRQAPGNGLEWIGTIGGSGDTYYASWAKSRSTIIRNTNENTVTLKMTSLTAADTATYFCVRYANIGYEYFNVWGPGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5953 - protein, 1140 aa, Artificial Sequence
  Synthetic Polypeptide encoding a CAR with optional accessory module(s)
MALPVTALLLPLALLLHAARPQFVLTQSPSVSAALGASAKLTCTLSSAHKTYTIDWYQQQQGEAPRYLMQVKSDGSYTKGTGVPDRFSGSSSGADRYLIIPSVQADDEAGYVCGADDNGGYVFGGGTQLTVTGGGGSGGGGSGGGGSQSVKESEGGLFKPTDTLTLTCTVSGFSLSRHALTWVRQAPGNGLEWIGAIDNAGTTYYASWAKSRSTITRNTDLHTVTLKMTSLTASDTATYFCARVFYDINSGYYLDGMDLWGPGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5954 - protein, 1134 aa, Artificial Sequence
  Synthetic Polypeptide encoding a CAR with optional accessory module(s)
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKGGGGSGGGGSGGGGSEVQLVESGGGLVQPGESLRLSCVASGFTFSRYKMNWVRQAPGKGLEWVSYISRSGRDIYYADSVKGRFTISRDNAKNSLYLQMNSLRDEDTAVYYCAGTVTTYYYFGMDVWGHGTTVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5955 - protein, 1135 aa, Artificial Sequence
  Synthetic Polypeptide encoding a CAR with optional accessory module(s)
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKGGGGSGGGGSGGGGSEVQLVESGGGSVQPGESLRLSCVASGFTFSRYKMNWVRQAPGKGLEWVSYISRSGRDIYYADSVKGRFTISRDNAKNSLYLQMNSLRDEDTAVYYCAGTVTTYYYDFGMDVWGQGTTVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5956 - protein, 1134 aa, Artificial Sequence
  Synthetic Polypeptide encoding a CAR with optional accessory module(s)
MALPVTALLLPLALLLHAARPQSVLTQPPSASGTPGQRVTISCSGSRSNVGGNYVFWYQQVPGATPKLLIYRSNQRPSGVPDRFAGSKSGSSASLAISGLRSEDEADYYCATWDDSLSGFVFGTGTKVTVLGGGGGSGGGGSGGGGSEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARGYGKAYDQWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5957 - protein, 1133 aa, Artificial Sequence
  Synthetic Polypeptide encoding a CAR with optional accessory module(s)
MALPVTALLLPLALLLHAARPQSVVTQPPSMSAAPGQQVTISCSGGNSNIERNYVSWYLQLPGTAPKLVIFDNDRRPSGIPDRFSGSKSGTSATLGITGLQTGDEADYYCGTWDSSLRGWVFGGGTKLTVLGGGGGSGGGGSGGGGSEVQLVESGGGLIQPGGSLRLSCAASGFTFSNYAMNWVRQAPGKGLEWVSTINGRGSSTIYADSVKGRFTISRDNSKNTLYLQMNSLRAEDTATYYCARYISRGLGDSWGQGTLVTVTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5958 - protein, 1133 aa, Artificial Sequence
  Synthetic Polypeptide encoding a CAR with optional accessory module(s)
MALPVTALLLPLALLLHAARPQSVVTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSYVFGTGTKLTVLGGGGGSGGGGSGGGGSEVQLVETGGNLVQPGASLRLSCAASGFSFSGTAMHWVRQAPGKGLEWVSTISSTGRSTYYRDSVKGRFTISRDNSKNTLYLQMNSLRGEDTAVYYCARVSFDYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5959 - protein, 1135 aa, Artificial Sequence
  Synthetic Polypeptide encoding a CAR with optional accessory module(s)
MALPVTALLLPLALLLHAARPQSVVTQPASVSGSPGQSITISCTGTSSDVGGYNYVSWYQQHPGKAPKLMIYDVSKRPSGVSNRFSGSKSGNTASLTISGLQAEDEADYYCSSYTSSSTLVFGGGTKLTVLGGGGGSGGGGSGGGGSEVQLVESGGAFVQPGGSLRLSCAASGFTFSSYAMTWVRQAPGKGLEWVSTISGRGRSTFYADSVKGRFTISRDNSKNTLYLQMNSLRAEDTAVYYCARYYHAGAFDLWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5960 - protein, 1133 aa, Artificial Sequence
  Synthetic Polypeptide encoding a CAR with optional accessory module(s)
MALPVTALLLPLALLLHAARPDNIELTQSPAIMSASPGERVTMTCSASSSIRYIYWYQQKPGSSPRLLIYDTSNVAPGVPFRFSGSGSGTSYSLTINRMEAEDAATYYCQEWSGYPYTFGGGTKLDIKRGGGGSGGGGSGGGGSQVKLQESGGGLVKPGGSLKLSCAASGFTFSSYGMSWVRQTPDKRLEWVATISSGGSYTYYPDSVKGRFTISRDNAKNTLYLQMSSLKSEDTAMYYCARGNWEGWYFDVWGQGTTVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5961 - protein, 1143 aa, Artificial Sequence
  Synthetic Polypeptide encoding a CAR with optional accessory module(s)
MALPVTALLLPLALLLHAARPDNFMLTQPHSVSESPGKTVTISCTGSGGSIDNNYVHWYQQRPGSAPTTVMFEDNQRPSGVPDRFSGSIDSSSNSASLVISGLKTEDEGDYYCQSSDGSKVVFGGGTKLTVLGQGGGGSGGGGSGGGGSEVQLVQSGGGSLTLSCAASGVVQPGRFTFSSYGMHWVRQAPGKGLEWVSVISYDGSNKYYADSVKGRFTISRDNSKNTLYLQMNSLRTEDTAVYYCAKTLSAGEWIGGGAFDIWGHGTMVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5962 - protein, 1133 aa, Artificial Sequence
  Synthetic Polypeptide encoding a CAR with optional accessory module(s)
MALPVTALLLPLALLLHAARPDVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQNTPVPPKFGSGTKLEIKGGGGSGGGGSGGGGSQVQLQQSGAELVRPGASVKLSCKASGYTFNDYEMHWVKQTPVHGLKWIGALEPKTGDTAYSQKFKGKATLTADKSSSTAYMELRSLTSEDSAVYYCTSCYYYTYSGQGTLVTVSATRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5963 - protein, 1132 aa, Artificial Sequence
  Synthetic Polypeptide encoding a CAR with optional accessory module(s)
MALPVTALLLPLALLLHAARPDIQLTQSPSSLSASVGDRVTITCRASQGIRNDLGWYQQKPGKAPKRLIYAASSLQNGVPSRFSGSGSGTEFTLTISSLQPEDFATYYCLQHNTYPAFGQGTKVEIKRGGGGSGGGGSGGGGSQVQLQESGPGLVKPSQTLSLTCTVSGGSISSFNYYWSWIRHHPGKGLEWIGYIYYSGSTYSNPSLKSRVTISVDTSKNQFSLTLSSVTAADTAVYYCARGYNWNYFDYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5964 - protein, 1134 aa, Artificial Sequence
  Synthetic Polypeptide encoding a CAR with optional accessory module(s)
MALPVTALLLPLALLLHAARPDDIVLTQSPASLAVSLGQSVTISCRASESVEYYGTSLMQWYQQKPGQPPKLLIYATSNVESGVPARFSGSGSGTDFSLNIHPVEEDDIAMYFCQQSRKLPSTFGGGTKLEIKGGGGSGGGGSGGGGSDVRLQESGPGQVKPSQTVSLTCSVTGYSITNGNHWWNWIRQVSGSKLEWIGYISSSGSTDSNPSLKSRISITRDTSKNQLFLQLNSVTTEDIATYYCARGYYFDYWGQGTTLTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5965 - protein, 1012 aa, Artificial Sequence
  Synthetic Polypeptide encoding a CAR with optional accessory module(s)
MALPVTALLLPLALLLHAARPDEFEVQLVESGGGLVQAGGSLRLSCAASGITFSINTMGWYRQAPGKQRELVALISSIGDTYYADSVKGRFTISRDNAKNTVYLQMNSLKPEDTAVYYCKRFRTAAQGTDYWGQGTQVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5966 - protein, 947 aa, Artificial Sequence
  Synthetic Polypeptide encoding a CAR with optional accessory module(s)
MDWIWRILFLVGAATGAHSFEGSGFEYAKEMRNAYWEIALLPNLTNQQKRAPIRKLYDDPSQSSELLSEAKKLNDSQTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5967 - protein, 1018 aa, Artificial Sequence
  Synthetic Polypeptide encoding a CAR with optional accessory module(s)
MALPVTALLLPLALLLHAARPDEFGSDLGIKLLFAAAKGQDDEVRILLAAGADVNAKDFEGYTPLHVAAYDGHLEIVEVLLKAGADVNAKDSQGRTPLHEAAYSGHLEIVEVLLKAGADVNAQDDAGETPADLAAAWGHEDIAEVLQKTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5968 - protein, 1017 aa, Artificial Sequence
  Synthetic Polypeptide encoding a CAR with optional accessory module(s)
MDWIWRILFLVGAATGAHSFERSDLGKKLLEAARAGQDDEVRILMANGADVNAKDEYGLTPLYLATAHGHLEIVEVLLKNGADVNAVDAIGFTPLHLAAFIGHLEIAEVLLKHGADVNAQDKFGKTAFDISIGNGNEDLAEILQKLNTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5969 - protein, 1169 aa, Artificial Sequence
  Synthetic Polypeptide encoding a CAR with optional accessory module(s)
MALPVTALLLPLALLLHAARPDEFEVQLVESGGGLVQAGGSLRLSCAASGITFSINTMGWYRQAPGKQRELVALISSIGDTYYADSVKGRFTISRDNAKNTVYLQMNSLKPEDTAVYYCKRFRTAAQGTDYWGQGTQVTVSSLEGGGGSGGGGSGGGGSGSGGSGSGGSGSGGSGSGGSFEVQLVESGGGLVQPGGSLRLSCAASGSIFGFNDMAWYRQAPGKQRELVALISRVGVTSSADSVKGRFTISRVNAKDTVYLQMNSLKPEDTAVYYCYMDQRLDGSTLAYWGQGTQVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5970 - protein, 1133 aa, Artificial Sequence
  Synthetic Polypeptide encoding a CAR with optional accessory module(s)
MALPVTALLLPLALLLHAARPDIQMTQSPSSLSASVGDRVTITCRASQDVNTAVAWYQQKPGKAPKLLIYSASFLESGVPSRFSGSRSGTDFTLTISSLQPEDFATYYCQQHYTTPPTFGQTKVEIKRGGGGSGGGGSGGGGSEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDVWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5971 - protein, 1012 aa, Artificial Sequence
  Synthetic Polypeptide encoding a CAR with optional accessory module(s)
MALPVTALLLPLALLLHAARPDEFDVQLVESGGGLVQPGGSLRLSCAASGSIGGLNAMAWYRQAPGKERELVAGIFGVGSTRYADSVKGRFTISRDNSKNTVYLQMNSLRPEDTAVYYCRMSSVTRGSSDYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5972 - protein, 952 aa, Artificial Sequence
  Synthetic Polypeptide encoding a CAR with optional accessory module(s)
MALPVTALLLPLALLLHAARPDEFVDNKFNKERYSAYYEIWQLPNLNVRQKAAFIGSLQDDPSQSANLLAEAKKLNDAQAPKTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5973 - protein, 1174 aa, Artificial Sequence
  Synthetic Polypeptide encoding a CAR with optional accessory module(s)
MALPVTALLLPLALLLHAARPDEFDVQLVESGGGLVQPGGSLRLSCAASGSIGGLNAMAWYRQAPGKERELVAGIFGVGSTRYADSVKGRFTISRDNSKNTVYLQMNSLRPEDTAVYYCRMSSVTRGSSDYWGQGTLVTVSSLEGGGGSGGGGSGGGGSGSGGSGSGGSGSGGSGSGGSFEVQLVESGGSLVQPGGSLRLSCAASGFTFDDYAMSWVRQVPGKGLEWVSSINWSGTHTDYADSVKGRFTISRNNANNTLYLQMNSLKSEDTAVYYCAKNWRDAGTTWFEKSGSAGQGTQVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5974 - protein, 1132 aa, Artificial Sequence
  Synthetic Polypeptide encoding a CAR with optional accessory module(s)
MALPVTALLLPLALLLHAARPDQSVLTQPPSVSVAPGKTARIPCEGNYIGSSNVHWYQQKPGQAPVLVIHFDSDRPSGIPDRFSGSNSGNMATLTISRVEAGDEADYYCQVWENHGWVFGGGTKLTVLSGGGGSGGGGSGGGGSEVQLVETGGGLVQPGESLRLSCAASGFTFSDYEMNWVRQAPGKGLEWVSYISSSGSTIYYADSVKGRFTIYRDNAKNSLYLQMNSLRAEDTALYYCARAWGVGPPDYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5975 - protein, 1140 aa, Artificial Sequence
  Synthetic Polypeptide encoding a CAR with optional accessory module(s)
MALPVTALLLPLALLLHAARPDIQMTQSPSSLSASVGDTVTITCQANGYLNWYQQRRGKAPKLLIYDGSKLERGVPSRFSGRRWGQEYNLTINNLQPEDIATYFCQVYEFVVPGTRLDLKRTVAAPGGGGSGGGGSGGGGSQVQLLQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTQVTVSSASTKGPTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5976 - protein, 1146 aa, Artificial Sequence
  Synthetic Polypeptide encoding a CAR with optional accessory module(s)
MALPVTALLLPLALLLHAARPQSALTQPPSASGSPGQSITISCTGTSNNFVSWYQQHAGKAPKLVIYDVNKRPSGVPDRFSGSKSGNTASLTVSGLQTDDEAVYYCGSLVGNWDVIFGGGTKLTVLGGGGSGGGGSGGGGSQPQLQESGPTLVEASETLSLTCAVSGDSTAACNSFWGWVRQPPGKGLEWVGSLSHCASYWNRGWTYHNPSLKSRLTLALDTPKNLVFLKLNSVTAADTATYYCARFGGEVLRYTDWPKPAWVDLWGRGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5977 - protein, 1131 aa, Artificial Sequence
  Synthetic Polypeptide encoding a CAR with optional accessory module(s)
MALPVTALLLPLALLLHAARPEIVLTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIKRGGGGSGGGGSGGGGSQVQLVQSGGQMKKPGESMRISCRASGYEFIDCTLNWIRLAPGKRPEWMGWLKPRGGAVNYARPLQGRVTMTRDVYSDTAFLELRSLTVDDTAVYFCTRGKNCDYNWDFEHWGRGTPVIVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5978 - protein, 1141 aa, Artificial Sequence
  Synthetic Polypeptide encoding a CAR with optional accessory module(s)
MALPVTALLLPLALLLHAARPELVLTQSPGTLSLSAGERATLSCRASQSVSSGSLAWYQQKPGQAPRLLIYGASTRATGIPDRFSGSGSGTDFTLTIGRLEPEDLAVYYCQQYGTSPYTFGQGTKLEIGGGGSGGGGSGGGGSLEQSGAEVKKPGSSVQVSCKASGGTFSMYGFNWVRQAPGHGLEWMGGIIPIFGTSNYAQKFRGRVTFTADQATSTAYMELTNLRSDDTAVYYCARDFGPDWEDGDSYDGSGRGFFDFWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5979 - protein, 1137 aa, Artificial Sequence
  Synthetic Polypeptide encoding a CAR with optional accessory module(s)
MALPVTALLLPLALLLHAARPDVVMTQSPSSLSASVGDRVTITCQSSLDISHYLNWYQQKPGKAPKLLIYDASNLETGVPSRFSGSGSGTHFTFTISSLQPEDFATYYCQQYDNLPLTFGGGTKLEIKRGGGGSGGGGSGGGGSQVQLVQSGGGVVQPGGSLRVSCAASGVTLSDYGMHWVRQAPGKGLEWVAFIRNDGSDKYYADSVKGRFTISRDNSEKTVSLQMSSLRAEDTAVYYCAKNGESGPLDYWYLDLWGRGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5980 - protein, 1137 aa, Artificial Sequence
  Synthetic Polypeptide encoding a CAR with optional accessory module(s)
MALPVTALLLPLALLLHAARPDDIVMTQSQDSMATSVGERVTVNCKASQNVDTNVAWYQQKPGQSPEPLLFSASYRYTGVPDRFSGSGSGTDFTLTISSVQAEDVAEYFCQQYNSYPLTFGQGTKLEIKRGGGGSGGGGSGGGGSEVQVEVSGGGLVQPGGSMRLSCAVSGFTFSNYWMNWVRQSPEKGLEWIAEIRLKSNNFARYYAESVKGRFTISRDNSKNSLYLQMISLRAEDTAIYYCTSYGNYVGHYFDHWGQGTLLTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5981 - protein, 1141 aa, Artificial Sequence
  Synthetic Polypeptide encoding a CAR with optional accessory module(s)
MALPVTALLLPLALLLHAARPSYELTQPPSVSGTPGQRVAISCSGSSSNIGTRMVTWYQHVPGTAPKLLIFNNNQRPSGVPDRFSASKSGTSASLAIIGLQSDDEADYYCATWDDNVKSYVFGTGTKVTVLGSRGGGGSGGGGSGGGGSLEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARAPQSWYVGDVWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5982 - protein, 1138 aa, Artificial Sequence
  Synthetic Polypeptide encoding a CAR with optional accessory module(s)
MALPVTALLLPLALLLHAARPQSVLTQPPSLSVAPGKTASITCGGNNIGMKSVHWYQQRPGQAPVLVIYYDSDRPSGIPGRFSGSNSGNTATLTISRVEAGDEADYYCQVWDTTGDHPGYVFGTGTKVTVLGGGGSGGGGSGGGGSQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGVYGYSGSAPYDEWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5983 - protein, 1144 aa, Artificial Sequence
  Synthetic Polypeptide encoding a CAR with optional accessory module(s)
MALPVTALLLPLALLLHAARPDEIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPRTFGQGTKVEIKRGGGGSGGGGSGGGGSQVQLVQSGGGVVQPGRSLRLSCAASGFTFSSYGMHWVRQAPGKGLEWVAVISYDGSNKYYADSVKGRFTISRDNSKNTLYLQMNSLRAEDTAVYYCARDFDYGDSYYYYGMDVWGQGTTVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5984 - protein, 1138 aa, Artificial Sequence
  Synthetic Polypeptide encoding a CAR with optional accessory module(s)
MALPVTALLLPLALLLHAARPDEIVLTQSPATLSLSPGERATLSCRASQSVGSYLAWYQQKPGAPRLLIYDASHRATGIPARFSGSGSGTDFTLTISSLEPEDFAVYYCQQRSNWPPMYTFGQGTKLEIKRGGGGSGGGGSGGGGSEVQLVQSGAEVSVKVSCKASGGKKPGSTFSSYTISWVRQAPGQGLEWMGGIIPIFGTANYAQKFQGRVTITADKSTSTAYMELSSLRSEDTAVYYCAGDTDSSGYYGAVDYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5985 - protein, 1121 aa, Artificial Sequence
  Synthetic Polypeptide encoding a CAR with optional accessory module(s)
MALPVTALLLPLALLLHAARPDIQMTQSPSSLSASVGDRVTITCQASQDINNYLNWYQQKPGKAPKLLIYDASNLQTGVPSRFSGSGSGTDFTFTIEDIATYYCQQYTFGPGTKVDIKGGGGSGGGGSGGGGSEVQLLESGGGLVQPGGSLRLSCAASGFTFSWYSMTWVRQAPGKGLEWVSSIVPWGDFTQYADSVKGRFTISRDNSKNTLYLQMNSLRAEDTAVYYCAKGPGWGSFDLWGRGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5986 - protein, 1010 aa, Artificial Sequence
  Synthetic Polypeptide encoding a CAR with optional accessory module(s)
MDWIWRILFLVGAATGAHSEVQLVESGGGLVQPGGSLRLSCAASGSVFKINVMAWYRQAPGKGRELVAGIISGGSTSYADSVKGRFTISRDNAKNTLYLQMNSLRPEDTAVYYCAFITTESDYDLGRRYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5987 - protein, 1131 aa, Artificial Sequence
  Synthetic Polypeptide encoding a CAR with optional accessory module(s)
MALPVTALLLPLALLLHAARPDIQMTQSPSSLSASVGDRVTITCTASLSVSSTYLHWYQQKPGSSPKLWIYSTSNLASGVPSRFSGSGSGTSYTLTISSLQPEDFATYYCHQYHRSPLTFGGGTKVEIKRGGGGSGGGGSGGGGSEVQLVESGGGLVQPGGSLRLSCAASGFSLTKYGVHWVRQAPGKGLEWVGVKWAGGSTDYNSALMSRFTISKDNAKNSLYLQMNSLRAEDTAVYYCARDHRDAMDYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5988 - protein, 1135 aa, Artificial Sequence
  Synthetic Polypeptide encoding a CAR with optional accessory module(s)
MALPVTALLLPLALLLHAARPDIQMTQSPSSLSASVGDRVTITCKASQDVGTAVAWYQQKPGKAPKLLIYSASYRSTGVPSRFSGSGSGTDFTLTISSLQPEDFATYYCQHHYSAPWTFGGGTKVEIKGGGGSGGGGSGGGGSEVQLVESGGGLVQPGGSLRLSCAASGFTFSRNGMSWVRQAPGKGLEWVATVSSGGSYIYYADSVKGRFTISRDNAKNSLYLQMNSLRAEDTAVYYCARQGTTALATRFFDVWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5989 - protein, 1141 aa, Artificial Sequence
  Synthetic Polypeptide encoding a CAR with optional accessory module(s)
MALPVTALLLPLALLLHAARPDIVMTQSPSSLTMSVGQKVTMSCKSSHSLLNSRNQKNYLAWFQQKPGQSPKLLVYFASTRESGVPDRFIGSGSGTDFTLTISNVQAEDLADYFCQQHYTTLPTFGGGTKLEIKGGGGSGGGGSGGGGSQIQLVQSGPDLKKPGETVKISCKASGYTFTNTGMNWVKQAPGKGLKWMGWINTYTGEPTYADDFKGRFTFSLETSASTAYLQINNLKNEDTATYFCTRWGYGSSLYYAMDYWGQGTSVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5990 - protein, 1131 aa, Artificial Sequence
  Synthetic Polypeptide encoding a CAR with optional accessory module(s)
MALPVTALLLPLALLLHAARPDIQMTQSPPSLSASVGGKVTITCKASQDIDRYMAWYQDKPGKGPKLLIHDTSTLQPGIPSRFSGSGSGRDYSFSISNLEPEDIATYYCLQYDNLWTFGGGTKLEIKRGGGGSGGGGSGGGGSQVQLVQSGAELVKPGASVKMSCKASGYIFTNYNIHWVKKSPGQGLEWIGAIYPGNGDAPYSQKFQDRATLTADTSSSTTYMELSSLTSEDSAVYYCVRANWDVAFAYWGQGTLVSVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5991 - protein, 1132 aa, Artificial Sequence
  Synthetic Polypeptide encoding a CAR with optional accessory module(s)
MALPVTALLLPLALLLHAARPDIQMTQSPASLSASVGETVTITCRVSGNIHNYLAWYQQKQGKSPQLLVYNAKTLADGVPSRFSGSGSGTQYSLKINSLQPEDFGSYYCQHFWSNPYTFGGGTKLEIKGGGGSGGGGSGGGGSQVQLQQSGASVKVSCKASELVRPGTGYAFTNYLIEWVKQRPGQGLEWIGVINPGSGGTNYNEKFKGKATLTADKSSSTAYMQLSSLTSDDSAVYFCARYRSYDWYFDVWGAGTTVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5992 - protein, 1137 aa, Artificial Sequence
  Synthetic Polypeptide encoding a CAR with optional accessory module(s)
MALPVTALLLPLALLLHAARPDDIQMTQSPSSLSASVGDRVTITCRSSQRIVHSNGNTYLEWYQQTPGKAPKLLIYKVSNRFSGVPSRFSGSGSGTDYTPTISSLQPEDIATYYCFQGSHVPPTFGQGTKLQITGGGGSGGGGSGGGGSEVQLVESGGGVVQPGRSLRLSCSSSGPTFSDYYMYWVRQAPGKGLEWVAYMSNVGAITDYPDTVKGRPTISRDNSKNTLFLMDSLRPEDTGVYFCARGTRDGSWFAYWGQGTPVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5993 - protein, 1131 aa, Artificial Sequence
  Synthetic Polypeptide encoding a CAR with optional accessory module(s)
MALPVTALLLPLALLLHAARPDIQMTQSFSSLSASVGDRVTITCRASQDISNYLNWYQQKPGKAPKLLIYYTSRLHSGVPSRFSGSGSGTDYTLTISSLQPEDFATYFCQQGNTLPWTFGGGTKLEIKRGGGGSGGGGSGGGGSEVQLVQSGGGLVQSGGSLRLSCRASGYTFTRYWMLWVRQRPGKGLEWVAEINPRNDRTNYNEKFKTRFTISVDRSKNTLYLQMDSLRAEDTAVYFCALGGGYAMDYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5994 - protein, 1118 aa, Artificial Sequence
  Synthetic Polypeptide encoding a CAR with optional accessory module(s)
MEMLQGLLLLLLLSMGGAWASREPLRPWCHPINAILAVEKEGCPVCITVNTTICAGYCPTMMRVLQAVLPPLPQVVCTYRDVRFESIRLPGCPRGVDPVVSFPVALSCRCGPCRRSTSDCGGPKDHPLTCDHPQLSGLLFLGGGGSGGGGSGGGGSAPDVQDCPECTLQENPFFSQPGAPILQCMGCCFSRAYPTPLRSKKTMLVQKNVTSESTCCVAKSYNRVTVMGGFKVENHTACHCSTCYYHKSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5995 - protein, 1132 aa, Artificial Sequence
  Synthetic Polypeptide encoding a CAR with optional accessory module(s)
MALPVTALLLPLALLLHAARPDIQMTQSPASLSASVGETVTIICRASVNIYSYLAWYQQKQGKSPQLLVYNAKILAEGVPSRFSGSGSGTQFSLKINSLQPEDFGSYYCQHHYGTFTFGSGTKLEIKRGGGGSGGGGSGGGGSQVQLKESGPGLVAPSQSLSITCTISGFSLTSYGVHWVRQPPGKGLEWLVVIWSDGSTTYNSALKSRLSISKDNSKSQVFLKMNSLQTDDTAIYYCASHYGSTLAFASWGHGTLVTVSAATRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5996 - protein, 1140 aa, Artificial Sequence
  Synthetic Polypeptide encoding a CAR with optional accessory module(s)
MALPVTALLLPLALLLHAARPDIVMTQSHKFMSTSVGDRVSVTCKASQNVGNNVAWYQQKPGQSPKVLIYSASYRYSGVPDRFTGSGSGTDFTLTISNVQSEDLAEYFCQQYNTYPFTFGSGTKLEIKGGGGSGGGGSGGGGSEVQLEESGGGLVQPGGSMKLSCVASGFTFSNYWMNWVRQSPEKGLEWVAEIRFKSHNYATHFAESVKGRFTISRDDSKSSVYLQMNNLRAEDTGIYYCTRRIGNSDYDWWYFDVWGAGTSVTVSSASTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5997 - protein, 1136 aa, Artificial Sequence; identical to SEQ ID NO: 5882
  Synthetic Polypeptide encoding a CAR with optional accessory module(s)

SEQ ID NO: 5998 - protein, 1142 aa, Artificial Sequence
  Synthetic Polypeptide encoding a CAR with optional accessory module(s)
MALPVTALLLPLALLLHAARPDQSVLTQPPSVSGAPGQRVTISCTGSSSNIGAGYDVHWYQQLPGTAPKLLIYGNSNRPSGVPDRFSGSKSGTSASLAITGLQAEDEADYYCQSYDNSLSSWVFGGGTKLTVLGQPKGGGGSGGGGSGGGGSEVQLQQSGAEVKKPGSSVKVSCKASGGTFSSYAISWVRQAPGQGLEWMGRIIPILGIANYAQKFQGRVTITADKSTSTAYMELSSLRSEDTAVYYCARDVGSGSYSLDYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5999 - protein, 1139 aa, Artificial Sequence
  Synthetic Polypeptide encoding a CAR with optional accessory module(s)
MALPVTALLLPLALLLHAARPDQSVVTQPPSVSAAPGRKVTISCSGSSSNIGSNYVSWYQQVPGTAPKLLIYEDDKRPSGIPDRFSGSKSGTSATLGITGLQTGDEADYFCATWDRTVNVVRFGGGTRLTVHSQPKGGGGSGGGGSGGGGSQLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARHVGHELDYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6000 - protein, 1133 aa, Artificial Sequence
  Synthetic Polypeptide encoding a CAR with optional accessory module(s)
MALPVTALLLPLALLLHAARPDIQMTQSPSSLSASVGDRVTITCRASQSISSYLNWYQQKPGKAPKLLIYAASSLQSGVPSGFSGSGSGTDFTLTISSLQPEDFATYYCQQSYSTPLTFGGGTKVEIKRGGGGSGGGGSGGGGSQVQLQESGPGLVKPSETLSLTCTVSGGSVSSGSYYWSWIRQPPGKGLEWIGYIYYSGSTNYNPSLKSRVTISVDTSKNQFSLKLSSVTAADTAVYYCAREGKNGAFDIWGQGTMVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6001 - protein, 1019 aa, Artificial Sequence
  Synthetic Polypeptide encoding a CAR with optional accessory module(s)
MALPVTALLLPLALLLHAARPDEFDVQLVESGGGLVQPGGSLRLSCAASGFILDYYAIGWFRQAPGKEREGVLCIDASDDITYYADSVKGRFTISRDNSKNTVYLQMNSLRPEDTAVYYCATPIGLSSSCLLEYDYDYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6002 - protein, 1182 aa, Artificial Sequence
  Synthetic Polypeptide encoding a CAR with optional accessory module(s)
MALPVTALLLPLALLLHAARPDEFDVQLVESGGGLVQPGGSLRLSCAASGFILDYYAIGWFRQAPGKEREGVLCIDASDDITYYADSVKGRFTISRDNSKNTVYLQMNSLRPEDTAVYYCATPIGLSSSCLLEYDYDYWGQGTLVTVSSLEGGSGSGGGGSGGGGSGSGGSGSGGSGSGGSGSGGSFEVQLVESGGGLVQPGGSLRLSCAASGRTYYLNAMGWFRQAPGKEREFVAAIDWSEGNKDYADSVKGRFTISRDNSKNTVYLQMNSLRPEDTAVYYCAADTPPWGPLIYIESYDSWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6003 - protein, 1133 aa, Artificial Sequence
  Synthetic Polypeptide encoding a CAR with optional accessory module(s)
MALPVTALLLPLALLLHAARPDQIVLTQSPAIMSASPGEKVTISCSASSSVSYMYWYQQKPGSSPKPWIYRTSNLASGVPARFSGSGSGTSYSLTISNMEAEDAAAYYCQQYHSYPTTFGGGTKLEVKGGGGSGGGGSGGGGSEVQLVESGGGLVQPKGSLKLSCAASGFSFNTYAMNWVRQAPGKGLEWIAHIRSKSNNFATYYADSVKDRFSISRDASENILFLQMNNLKTEDTAMYYCVRQGGDFPMDYWGQGTSVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6004 - protein, 1132 aa, Artificial Sequence
  Synthetic Polypeptide encoding a CAR with optional accessory module(s)
MALPVTALLLPLALLLHAARPDDIQMTQSSSSFSVSLGDRVTITCMASEDIYIRLAWYQQKPGNAPRLLISAATSLETGVPSRFSGSGSGKDYTLSITSLQTEDVGTYYCQQYWSSPWTFGGGTKLEINGGGGSGGGGSGGGGSDVQLQESGPGLVKPSQSLSLTCTVTGYSITSDYTWNWIRQFPGNKLEWMGYITYSGSTSYNPSLKSRNSITRDTSKNQFFLQLNSVTTEDTATYYCARLGRRYTMDYWGQGTSVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6005 - protein, 1131 aa, Artificial Sequence
  Synthetic Polypeptide encoding a CAR with optional accessory module(s)
MALPVTALLLPLALLLHAARPDVQLQESGPGLVKPSQSLSLTCTVTGYSITSDYTWNWIRQFPGNKLEWMGYITYSGSTSYNPSLKSRNSITRDTSKNQFFLQLNSVTTEDTATYYCARLGRRYTMDYWGQGTSVTVSSGGGGSGGGGSGGGGSDIQMTQSSSSFSVSLGDRVTITCMASEDIYIRLAWYQQKPGNAPRLLISAATSLETGVPSRFSGSGSGKDYTLSITSLQTEDVGTYYCQQYWSSPWTFGGGTKLEINTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6006 - protein, 1132 aa, Artificial Sequence
  Synthetic Polypeptide encoding a CAR with optional accessory module(s)
MALPVTALLLPLALLLHAARPDIQMTQSSSSFSVSLGDRVTITCKASEDIYIRLAWYQQKPGNAPRLLISAATSLETGIPSRFSGSGSGEDYTLTITSLQTEDVATYYCQQYWTTPWTFGGGTKLEIKRGGGGSGGGGSGGGGSDVQLQESGPGLVKPSQSLSLTCTVTGYSITIDYTWNWIRQFPGNKLEWMGYITYSGSTDYNPSLKSRSSITRDTSMNQFFLQLNSVTTEDTATYYCARLGRRYALDYWGQGTSVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6007 - protein, 1133 aa, Artificial Sequence
  Synthetic Polypeptide encoding a CAR with optional accessory module(s)
MALPVTALLLPLALLLHAARPDIVMTQAAPSIPVTPGESVSISCRSDKSLLHSNGNTYLFWFLQRPGQSPQLLIYRMSNLASGVPDRFSGSGSGTAFTLRISGVEAEDVGVYYCMQHLEYPYTFGGGTKLEIKGGGGSGGGGSGGGGSQVQLQQSGPELVKPGASVKMSCKASGYAFSSSWLNWVRQRPGKGLEWIGRIYPGDGENHYNGKFKGKATLTADKSSSTGYMQLSSLTSEDSAVYFCASYYEGGYWGQGTLITVSATRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6008 - protein, 1132 aa, Artificial Sequence
  Synthetic Polypeptide encoding a CAR with optional accessory module(s)
MALPVTALLLPLALLLHAARPDIVLTQSPASLAVSLGQSVTISCRASESVEYYGTSLMQWYQQKPGQPPKLLIYGASNVESGVPARFSGSGSGTDFSLNIHPVEEDDIAMYFCQQSRKVPWTFGGGTKLEIKGGGGSGGGGSGGGGSEVKLVESGGGLVKPGGSRKLSCAASGFTFSSYTMSWVRQTPAKRLEWVATISSGSSTIYYADTVKGRFTISRDNAKNTLFLQMTSLRSEDTAMYYCARRWFLDCWGQGTTLTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6009 - protein, 1135 aa, Artificial Sequence
  Synthetic Polypeptide encoding a CAR with optional accessory module(s)
MALPVTALLLPLALLLHAARPDQVQLQQSGPGLVKPSETLSLTCTVSGDSISSYYWSWIRQPPGKGLEWIGYIYYSGSTNYNPSLKSRVTISVDTSKSQFSLKLSSVTAADTAVYYCARGRYFDVWGRGTMVTSSGGGGSGGGGSGGGGSSSYVLTQPPSVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLGAAATRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6010 - protein, 1136 aa, Artificial Sequence
  Synthetic Polypeptide encoding a CAR with optional accessory module(s)
MALPVTALLLPLALLLHAARPDIVMTQSPLSLPVTPGEPASISCRSSKSLLHSNGNTYLYWFQQKPGQAPRLLIYRMSNLASGVPDRFSGSGSGTAFTLKISRVEAEDVGVYYCMQHIEYPFTFGQGTKLEIKGGGGSGGGGSGGGGSQVQLVQSGPEVKKPGASVKVSCKASGYTFTNSWMNWVRQRPGKGLEWIGRIYPGDGETIYNGKFRVRVTITADESTSTAYMELSSLRSEDTAVYYCARGYDDYSFAYWGQGTTVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6011 - protein, 1136 aa, Artificial Sequence
  Synthetic Polypeptide encoding a CAR with optional accessory module(s)
MALPVTALLLPLALLLHAARPDEIVMTQSPATLSLSPGERATLSCRASQSVSSYLAWYQQKPGQAPRLLIYDASNRATGIPARFSGSGSGTDFTLTISSLEPEDFAVYYCHQYGSSPQTFGQGTKVEIKRGGGGSGGGGSGGGGSEVQLVQSGAEVKKPGSSVKVSCKASGGTFSSYAISWVRQAPGQGLEWMGGIIPIFGTANYAQKFQGRVTITADESTSTAYMELSSLRSEDTAVYYCAVHYGDYVFSSMDVWGQGTTVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6012 - protein, 1139 aa, Artificial Sequence
  Synthetic Polypeptide encoding a CAR with optional accessory module(s)
MALPVTALLLPLALLLHAARPDETTLTQSPGTLSLSPGERATLSCRASQSVSSSYLAWYQQKPGQAPRLLIYGASSRATGIPDRFSGSGSGTDFTLTISRLEPEDFAVYYCQQYGSSPRTFGQGTKVEIKRGGGGSGGGGSGGGGSEVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGPEYCINGVCSLDVWGQGTTVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6013 - protein, 1141 aa, Artificial Sequence
  Synthetic Polypeptide encoding a CAR with optional accessory module(s)
MALPVTALLLPLALLLHAARPDIELTQSPSSLAVSAGEKVTMSCKSSQSLLNSRTRKNQLAWYQQKPGQSPELLIYWASTRQSGVPDRFTGSGSGTDFTLTISSVQAEDLAVYYCQQSYNLLTFGPGTKLEVKRGGGGSGGGGSGGGGSVKLQESGGGFVKPGGSLKVSCAASGFTFSSYAMSWVRLSPEMRLEWVATISSAGGYIFYSDSVQGRFTISRDNAKNTLHLQMGSLRSGDTAMYYCARQGFGNYGDYYAMDYWGQGTTVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6014 - protein, 1140 aa, Artificial Sequence
  Synthetic Polypeptide encoding a CAR with optional accessory module(s)
MALPVTALLLPLALLLHAARPDIQMTQSPSSLSASVGDRVTITCRSSQNIVHSNGNTYLDWYQQTPGKAPKLLIYKVSNRFSGVPSRFSGSGSGTDFTFTISSLQPEDIATYYCFQYSHVPWTFGQGTKLQIGGGGSGGGGSGGGGSQVQLQQSGAEVKKPGSSVKVSCKASGYTFTNYYIYWVRQAPGQGLEWIGGINPTSGGSNFNEKFKTRVTITADESSTTAYMELSSLRSEDTAFYFCTRQGLWFDSDGRGFDFWGQGTTVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6015 - protein, 1036 aa, Artificial Sequence
  Synthetic Polypeptide encoding a CAR with optional accessory module(s)
MALPVTALLLPLALLLHAARPLFNQEVQIPLTESYCGPCPKNWICYKNNCYQFFDESKNWYESQASCMSQNASLLKVYSKEDQDLLKLVKSYHWMGLVHIPTNGSWQWEDGSILSPNLLTIIEMQKGDCALYASSFKGYIENCSTPNTYICMQRTVGGGGSGGGGDTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6016 - protein, 1130 aa, Artificial Sequence
  Synthetic Polypeptide encoding a CAR with optional accessory module(s)
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIKRGGGGSGGGGSGGGGSQVHLQESGPGLVKPSETLSLTCTVSDDSISSYYWSWIRQPPGKGLEWIGHISYSGSANYNPSLKSRVTISVDTSKNQFSLKLSSVTAADTAVYYCANWDDAFNIWGQGTMVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6017 - protein, 1132 aa, Artificial Sequence
  Synthetic Polypeptide encoding a CAR with optional accessory module(s)
MALPVTALLLPLALLLHAARPDVVMTQTPLTLSVTIGQPASISCKSSQSLLDSDGKTYLHWLLQRPGQSPKRLIFLVSKLDSGVPDRFTGSGSGTDFTLKISRVEAEDLGVYYCWQGTHFPQTFGGGTKLEIKGGGGSGGGGSGGGGSVQLQESGPDLVKPSQSLSLTCTVTGYSITSGYSWHWIRQFPGNKLEWMGYIHYSGDTDYNPSLKSRFSITRDTSKNQFFLQLNSVTTEDTATYYCATPGGFVYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6018 - protein, 1136 aa, Artificial Sequence
  Synthetic Polypeptide encoding a CAR with optional accessory module(s)
MALPVTALLLPLALLLHAARPDQSELTQPRSVSGSPGQSVTISCTGTERDVGGYNYVSWYQQHPGKAPKLIIHDVIERSSGVPDRFSGSKSGNTASLTISGLQAEDEADYYCWSFAGGYYVFGTGTDVTVLGGGGSGGGGSGGGGSFEVQLLESGGGLVQPGGSLRLSCAASGFTFSTYQMSWVRQAPGKGLEWVSGIVSSGGSTAYADSVKGRFTISRDNSKNTLYLQMNSLRAEDTAVYYCAGELLPYYGMDVWGQGTTVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6019 - protein, 1135 aa, Artificial Sequence
  Synthetic Polypeptide encoding a CAR with optional accessory module(s)
MALPVTALLLPLALLLHAARPDQSELTQPRSVSGSPGQSVTISCTGTERDVGGYNYVSWYQQHPGKAPKLIIHDVIERSSGVPDRFSGSKSGNTASLTISGLQAEDEADYYCWSFAGGYYVFGTGTDVTVLGGGGSGGGGSGGGGSEVQLLESGGGLVQPGGSLRLSCAASGFTFSTYEMHWVRQAPGKGLEWVSVILSSGGETNYADSVKGRFTISRDNSKNTLYLQMNSLRAEDTAVYYCAGMLLPYYGMDVWGQGTTVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6020 - protein, 1037 aa, Artificial Sequence
  Synthetic Polypeptide encoding a CAR with optional accessory module(s)
MALPVTALLLPLALLLHAARPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6021 - protein, 1132 aa, Artificial Sequence
  Synthetic Polypeptide encoding a CAR with optional accessory module(s)
MALPVTALLLPLALLLHAARPDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRGGGGSGGGGSGGGGSEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6022 - protein, 1133 aa, Artificial Sequence
  Synthetic Polypeptide encoding a CAR with optional accessory module(s)
MALPVTALLLPLALLLHAARPAIVMTQTPSPVSAAVGGTVTINCQASESVYSNNYLSWFQQKPGQPPKLLIYLASTLASGVPSRFKGSGSGTQFTLTISGVQCDDAATYYCIGGKSSSTDGNAFGGGTEVVVRGGGGSGGGGSGGGGSQSLEESGGRLVKPDETLTITCTVSGIDLSSNGLTWVRQAPGEGLEWIGTINKDASAYYASWAKGRLTISKPSSTKVDLKITSPTTEDTATYFCGRIAFKTGTSIWGPGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6023 - protein, 1131 aa, Artificial Sequence
  Synthetic Polypeptide encoding a CAR with optional accessory module(s)
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKGGGGSGGGGSGGGGSQVQLVQSGAEVKKPGASVKVSCKASGYTFTSYDVHWVRQAPGQRLEWMGWLHADTGITKFSQKFQGRVTITRDTSASTAYMELSSLRSEDTAVYYCARERIQLWFDYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6024 - protein, 1150 aa, Artificial Sequence
  Synthetic Polypeptide encoding a CAR with optional accessory module(s)
MALPVTALLLPLALLLHAARPDDIVMTQSPLSLPVTPGEPASISCRSSQSLLHSNGYNYLVWYLQKPGQSPQLLIYLGSIRASGVPDRFSGSGSGTDFTLKISRVEAEDVGVYYCMQPLQTPITFGQGTRLEIKRGGGGSGGGGSGGGGSGLQCVAAPRWVLSQVQLQQWGAGLLKPSETLSLTCAVYGGSFSGNYWSWIRQPPGKGLEWIGEINHSGSTNYNPSLKSRVTISVDTSKNQFSLKLSSVTAADTAVYYCARGGSYNYFDYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6025 - protein, 1147 aa, Artificial Sequence
  Synthetic Polypeptide encoding a CAR with optional accessory module(s)
MALPVTALLLPLALLLHAARPDQLTQSPSSVSASVGDRVTITCRASRGISSWLAWYQQKPGKAPKLLIYTASSLQSGVPSRFSGSGSGTDFTLTISSLQPEDFATYYCQQAYSFPRTFGQGTKVEIKRGGGGSGGGGSGGGGSVAAPRWVLSQVQLQESGPGLVKPSQTLSLTCTVSGGSISSGGYYWIWIRQHPGKGLEWIGYIYYNGNTYYNPSLKSRVTMSVDTSKNQFSLKLSSVTAADTAVYYCARDGITMIRGYYYGMDVWGQGTTVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6026 - protein, 1121 aa, Artificial Sequence
  Synthetic Polypeptide encoding a CAR with optional accessory module(s)
MALPVTALLLPLALLLHAARPDIVVTQSPASLAVSLGQRATISYRASKSVSTSGYSYMHWNQQKPGQPPRLLIYLVSNLESGVPARFSGSGSGTDFTLNIHPVEEEDAATYYCQHIRELTRSEGGPSWKGGGGSGGGGSGGGGSEVKLEESGGDLVKPGGSLKLSCAASGFTFSGYGMSWVRQTPDKRLEWVATISSGGSYTYYPDSVKGRFTISRDNAKNTLYLQMSSLKSEDTAMYYCARHEGGYYGSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6027 - protein, 1137 aa, Artificial Sequence
  Synthetic Polypeptide encoding a CAR with optional accessory module(s)
MALPVTALLLPLALLLHAARPDDIQMTQSPSSLSASVGDRVTITCRASQGISNYLAWYQQKTGKVPKFLIYEASTLQSGVPSRFSGGGSGTDFTLTISSLQPEDVATYYCQNYNSAPFTFGPGTKVDIKGGGGSGGGGSGGGGSQVQLVESGGGVVQPGRSLRLSCAASGFAFSRYGMHWVRQAPGKGLEWVAVIWYDGSNKYYADSVKGRFTISRDNSKNTQYLQMNSLRAEDTAVYYCARGGDFLYYYYYGMDVWGQGTTVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6028 - protein, 1128 aa, Artificial Sequence
  Synthetic Polypeptide encoding a CAR with optional accessory module(s)
MALPVTALLLPLALLLHAARPDIQMTQSPSSLSTSVGDRVTLTCKASQDVGTAVDWYQQKPGPSPKLLIYWASTRHTGIPSRFSGSGSGTDFTLTISSLQPEDFADYYCQQYNSYPLTFGPGTKVDIKGGGGSGGGGSGGGGSEVQLVQSGPEVKKPGATVKISCKTSGYTFTEYTIHWVKQAPGKGLEWIGNINPNNGGTTYNQKFEDKATLTVDKSTDTAYMELSSLRSEDTAVYYCAAGWNFDYWGQGTLLTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6029 - protein, 1129 aa, Artificial Sequence
  Synthetic Polypeptide encoding a CAR with optional accessory module(s)
MALPVTALLLPLALLLHAARPDIQMTQSPSSLSASVGDRVTITCKASQDIYPYLNWFQQKPGKAPKTLIYRTNRLLDGVPSRFSGSGSGTDFTFTISSLQPYYCLQYDEFPLTFGAGTKLEIKRGGGGSGGGGSGGGGSQITLKESGPTLVKPTQTLTLTCTFSGFSLSTSNMGVGWIRQPPGKALEWLAHIWWDDDKYYSPSLKSRLTITKDTSKNQVVLTMTNMDPVDTATYYCVRSNYGYAWFAYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6030 - protein, 1129 aa, Artificial Sequence
  Synthetic Polypeptide encoding a CAR with optional accessory module(s)
MALPVTALLLPLALLLHAARPDIVMTQSQKFMSTSVGDRVNVTCKASQNVGTNVVWYQQKTGQSPKALIHSASYRYSGVPDRFTGSGSGTDFTLTLSNVQSEDLAEYFCQHYNSFPYTFGGGTKLEIKRGGGGSGGGGSGGGGSQVQLQQSGAELVRPGVSVKISCKGSGYRFTDYPIHWVKQSHAKSLEWIGIISTYYGDVTNNPKFRGKATMTVDKSSTTAYMELARLTSEDSAIYYCARNDLFAYWGQGTLVTVSATRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6031 - protein, 1132 aa, Artificial Sequence
  Synthetic Polypeptide encoding a CAR with optional accessory module(s)
MALPVTALLLPLALLLHAARPDIKMTQSPSSMYASLGERVTITCKASPDINSYLSWFQQKPGKSPKTLIYRANRLVDGVPSRFSGGGSGQDYSLTINSLEYEDMGIYYCLQYDEFPYTFGGGTKLEMKGGGGSGGGGSGGGGSEVKLVESGGGLVKPGGSLKLSCAASGFTFSSYAMSWVRQIPEKRLEWVASISRGGTTYYPDSVKGRFTISRDNVRNILYLQMSSLRSEDTAMYYCGRYDYDGYYAMDYWGQGTSVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6032 - protein, 1135 aa, Artificial Sequence
  Synthetic Polypeptide encoding a CAR with optional accessory module(s)
MALPVTALLLPLALLLHAARPDDVVVTPVSCFLSCISGAEGHHLIQGQQKCQYIWLLYALEPTETRTATQTPHLSCIQPRIWGPCQVQWQWVWDRLHPQHPSCGGGGCCNLLLSAHGAYTFGGGTRLELKGGGGSGGGGSGGGGSEVKLQESGPELVKPGASVKMSCKASGYTFTSYVMHWVKQKPGQGLEWIGYINPYNDGTKYNEKFKGKATLTSDKSSSTAYMELSSLTSEDSAVYYCARWKIYYGNYEDYWGQGTPLTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6033 - protein, 1165 aa, Artificial Sequence
  Synthetic Polypeptide encoding a CAR with optional accessory module(s)
MALPVTALLLPLALLLHAARPDEFQVQLVQSGGGLVQPGGSLRLSCAASDFDFAAYEMSWVRQAPGQGLEWVAIISHDGIDKYYTDSVKGRFTISRDNSKNTLYLQMNTLRAEDTATYYCLRLGAVGQGTLVTVSSLEGGGGSGGGGSGGGGSGSGGSGSGGSGSGGSGSGGSFEQVQLVQSGGGLVQPGGSLRLSCAASDFAFDDYEMSWVRQAPGKALEWIGDINHSGTTIYNPSLKSRVTISRDNSKNTLYLQMNTLRAEDTAIYYCARPHYGDYSDAFDIWGQGTMVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6034 - protein, 1140 aa, Artificial Sequence
  Synthetic Polypeptide encoding a CAR with optional accessory module(s)
MALPVTALLLPLALLLHAARPEIVMTQSPATLSVSPGERATLSCRASQSVSSNLAWYQQKPGQAPRLLIYGASTRATGIPARFSGSGSGTDFTLTISSLQSVDSAVYYCQQYNNWPPYTFGQGTKLEIKGGGGSGGGGSGGGGSQVQLLESGGGVVQPGRSLRLSCAASGFTFSFYGMHWVRQAPGKGLEWVAAISYDGSNKYYADSVKGRFTISRDNSKNTLYLQMNSLRAEDTAVYYCAKRPNQFYCSDGRCYSIDYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6035 - protein, 1136 aa, Artificial Sequence
  Synthetic Polypeptide encoding a CAR with optional accessory module(s)
MALPVTALLLPLALLLHAARPQSVLTQPPSASAGGTPGQRVTISCSGSSSNIGSNFVYWYQQLPGTAPKLLIYRNNQRPSGVPDRFSGSRSGTSASLAGLRSEDEADYYCAADSLGGHYVFGTGTKVLGGGGSGGGGSGGGGSQVQLVESGGGSVQPGRSLRLSCEASGFTFEAYAMHWVRQPPGKGLEWVSSINWNSGRIAYADSVKGRFTISRDNARNSLYLQMNSLRLEDTAFYYCAKDIRRFSTGGAEFEYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6036 - protein, 1131 aa, Artificial Sequence
  Synthetic Polypeptide encoding a CAR with optional accessory module(s)
MALPVTALLLPLALLLHAARPENVLTQSPAIMSASPGEKVTMTCSASSSVSYMHWYQQKSSTSPKLWIYDTSKLASGVPGRFSGSGSGNSYSLTISSMEAEDVATYYCFQGSGYPLTFGAGTKLELKGGGGSGGGGSGGGGSQVQLKESGPGLVAPSQSLSITCTVSGFSLSSQGVYWVRQPPGKGLEWLGAIWAGGSTNYNSALMSRLSISKDNSKSQVFLKMNSLQTDDTAMYYCARVDGYRGYNMDYWGQGTSVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6037 - protein, 1135 aa, Artificial Sequence
  Synthetic Polypeptide encoding a CAR with optional accessory module(s)
MALPVTALLLPLALLLHAARPDDIQMTQSPSSLSASVGDRVTITCRASQSISSYLNWYQQKPGKAPKLLIYDASNLETGVPSRFSGSGSGTDFTFTISSLQPEDIATYYCQQYDNLPLTFGGGTKVDIKRGGGGSGGGGSGGGGSQVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARAHNSSSWSFDYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6038 - protein, 1144 aa, Artificial Sequence
  Synthetic Polypeptide encoding a CAR with optional accessory module(s)
MALPVTALLLPLALLLHAARPDDVVMTQSPLSLPVSLGDQASISCRSSQRLVHSNGNTYLHWYLQKPGQSPKLLIYRVSNRFPGVPDRFSGSGSGTDFTLKISRVEAEDLGIYFCSQSTHVPYTFGGGTKLEIKRGGGGSGGGGSGGGGSEVRLQQSGPDLIKPGASVKMSCKASGYTFTGYVMHWVKQRPGQGLEWIGFINPYNDDIQSNERFRGKATLTSDKSSTTAYMELSSLTSEDSAVYYCARGAGYNFDGAYRFFDFWGQGTTLTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6039 - protein, 1135 aa, Artificial Sequence
  Synthetic Polypeptide encoding a CAR with optional accessory module(s)
MALPVTALLLPLALLLHAARPDSYELTQPPSVSVSPGQTATISCSGDQLGGKYGHWYQKKPGQSPVLVLYQDRKRPAGIPERFSGSSSGNTITLTISGTQAVDEADYYCQAWDTNLGGVFGGGTKVTVLGQGGGGSGGGGSGGGGSQVQLVESGAEVKKPGASVKVSCKASGYTFTGYYMHWVRQAPGQGLEWMGRINPNSGGTNYAQKFQGRVTMTRDTSISTAYMELSRLRSDDTAVYYCASPRGRGSAFDIWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6040 - protein, 1138 aa, Artificial Sequence
  Synthetic Polypeptide encoding a CAR with optional accessory module(s)
MALPVTALLLPLALLLHAARPDNFMLTQPHSVSESPGKTVTISCTRSSGSIASKYVQWYQQRPGSSPTTVIYEDNQRPSGVPDRFSGSIDTSSNSASLTISGLRTEDEADYYCHSYDSNNHSVFGGGTKVTVLGQGGGGSGGGGSGGGGSEVQLVESGGGVVQPGGSLRLSCAASGFTFSSYAMSWVRQAPGKGLEWVSAISGSGGSTYYADSVKGRFSISRDNSKNTLYLQMNSLRAEDTAVYYCARTRSSGAFDIWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6041 - protein, 1133 aa, Artificial Sequence
  Synthetic Polypeptide encoding a CAR with optional accessory module(s)
MALPVTALLLPLALLLHAARPDIQMNQSPSSLSASLGDTITITCHASQNINVWLSWYQQKPGNIPKLLIYKASNLHTGVPSRFSGSGSGTGFTITISSLQPEDIATYYCQQGQSYPWTFGGGTKLEIKRGGGGSGGGGSGGGGSEVQLQQSGPELVKPGASVKISCKASGYSFTGYFMNWVKQSHGKSLEYIGRFNPYNGETLYNQKFKGKATLTVDKSSSTVHMELLSVTSEDSAVYYCGRSGNDDAMDYWGQGTSVTVSSATRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6042 - protein, 1134 aa, Artificial Sequence
  Synthetic Polypeptide encoding a CAR with optional accessory module(s)
MALPVTALLLPLALLLHAARPDDIQMTQSPSILSASVGDRVTITCRASQRFGDYLAWYQQKPGQAPKLLIYGASTLQSGVPSRFSGSGSGTEFTLTISGLQPEDFATYYCQQANSFPITFGKGTRLDIRRGGGGSGGGGSGGGGSQVQLVQSGAEVKKPGSSVKVSCKASGGTFSSYAISWVRQAPGQGLEWMGWINVGNGNAIYSQKFQGRVTITRDTSATTAYMELSSLRSEDTAVYYCARDGERAWDLDYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6043 - protein, 1139 aa, Artificial Sequence
  Synthetic Polypeptide encoding a CAR with optional accessory module(s)
MALPVTALLLPLALLLHAARPDETTLTQSPGTLSLSPGERATLSCRASQSVSSSYLAWYQQKPGQAPRLLIYGASSRATGIPDRFSGSGSGTDFTLTISRLEPEDFAVYYCQQYGSSPYTFGQGTKLEIKRGGGGSGGGGSGGGGSQVQLVQSGGGVVQPGRSLRLSCAASGFTFSSYAMHWVRQAPGKGLEWVAVISYDGSNKYYADSVKGRFTISRDNSKNTLYLQMNSLRAEDTAVYYCARELRFLEWSSDAFDIWGQGTMVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6044 - protein, 1134 aa, Artificial Sequence
  Synthetic Polypeptide encoding a CAR with optional accessory module(s)
MALPVTALLLPLALLLHAARPEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKGGGGSGGGGSGGGGSQLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPTMIRGVIDSWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6045 - protein, 1131 aa, Artificial Sequence
  Synthetic Polypeptide encoding a CAR with optional accessory module(s)
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKGGGGSGGGGSGGGGSQVQLVQSGAEVRKPGSSVKVSCKASGGSFNNYPIFWVRQAPGQGFEWMGRIIPILGITAYAQKFQGRVTITADKSTSTAYMELNSLRSEDTAVYYCAGGDDLDAFDIWGQGTMVSVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6046 - protein, 1143 aa, Artificial Sequence
  Synthetic Polypeptide encoding a CAR with optional accessory module(s)
MALPVTALLLPLALLLHAARPDIVMTQTPLSLPVTPGEPASISCRSSRSLLDSDDGNTYLDWYLQKPGQSPQLLIYTLSYRASGVPDRFSGSGSGTDFTLKISRVEAEDVGVYYCMQRVEFPITFGQGTRLEIKRGGGGSGGGGSGGGGSQVQLVESGGGVVQPGRSLRLSCAASGFIFSRYGMHWVRQAPGKGLKWVAVIWYDGSNKLYADSVKGRFTISRDNSKNTLYLQMNSLRAEDTAVYYCARDYYDNSRHHWGFDYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6047 - protein, 1133 aa, Artificial Sequence
  Synthetic Polypeptide encoding a CAR with optional accessory module(s)
MALPVTALLLPLALLLHAARPEIQMTQSPSSMSASLGDTITITCQATQDIFKNLNWYQQKPGKPPSLLIYYATELAEGVPSRFSGSGSGSDYSLTISNLESEDFAAYYCLQFFEFPFTFGSGTKLEMKGGGGSGGGGSGGGGSQVQLQQSGAELVRPGTSVKVSCKASGYVFTNYWIEWIKQRPGQGLEWIGVMNPGSGETTYNEKFKGKATLTADKSSSTAYMQLSSLTSVDSAVYFCARDHDRDYYAMDYWGQGTSVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6048 - protein, 1130 aa, Artificial Sequence
  Synthetic Polypeptide encoding a CAR with optional accessory module(s)
MALPVTALLLPLALLLHAARPDILLTQSPAILSVSPGERVSFSCRASQNIGTSIHWYQQRTNGSPRLLIKYASESVSGIPSRFSGSGSGTDFTLSINSVESEDIADYYCQHTNSWPTTFGGGTKLEIKRGGGGSGGGGSGGGGSQVQLQQSDAELVKPGASVKISCKASGYTFTDHAIHWVKQKPEQGLEWIGYFSPGNGDIKYNEKFKGKATLTADKSSSTAYMQLNSLTSEDSAVYFCKRSYGNYDYWGQGTTLTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6049 - protein, 1135 aa, Artificial Sequence
  Synthetic Polypeptide encoding a CAR with optional accessory module(s)
MALPVTALLLPLALLLHAARPDIVMTQSPDSLAVSLGERATINCKSSQSLLNSGDQKNYLTWYQQKPGQPPKLLIYWASTRESGVPDRFSGSGSGTDFTLTISSLQAEDVAVYYCQNDYSYPLTFGQGTKVEIKGGGGSGGGGSGGGGSQVQLVQSGAEVKKTGSSVKVSCKASGYTFTDHAIHVWRQAPGQALEWMGHFSPGNTDIKYNDKFKGRVTLTVDRSMSTAYMELSSLRSEDTAMYYCKTSTFFFDYWGQGTMVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6050 - protein, 1057 aa, Artificial Sequence
  Synthetic Polypeptide encoding a CAR with optional accessory module(s)
MELTELLLVVMLLLTARLTLSSPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLLGTQLPPQGRTTAHKDPNAIFLSFQHLLRGKVRFLMLVGGSTLCVRRAPPTTAVPSRTSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6051 - protein, 1134 aa, Artificial Sequence
  Synthetic Polypeptide encoding a CAR with optional accessory module(s)
MALPVTALLLPLALLLHAARPDIQMTQSPSSLSASVGDRVTITCKASQDVSIAVAWYQQKPGKAPKVLIYSASYRYTGVPDRFSGSGSGTDFTFTISSLQPEDIAVYYCQQHYITPLTFGGGTKVEIKGGGGSGGGGSGGGGSQIQLVQSGHEVKKPGASVKVSCKASGYTFTNYGMNWVRQAPGQGLEWMGWINTKTGEPTYAEEFKGRFVFSLETSASTAYLQISSLKAEDTAMYFCGRGGYGSSYWYFDVWGQGTTVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6052 - protein, 1136 aa, Artificial Sequence
  Synthetic Polypeptide encoding a CAR with optional accessory module(s)
MALPVTALLLPLALLLHAARPDIVMTQSPDSLAVSLGERATINCRASKSVSTSGYSYMHWYQQKPGQPPKLLIYLASNLESGVPDRFSGSGSGTDFTLTISSLQAEDVAVYYCQHSRELPYTFGQGTKLEIKGGGGSGGGGSGGGGSQVQLQESGPGLVKPSETLSLTCTVSGGSISSYGVHWIRQPPGKGLEWIGVIWTSGVTDYNSALMGRVTISVDTSKNQFSLKLSSVTAADTAVYYCARDGDYDRYTMDYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6053 - protein, 1115 aa, Artificial Sequence
  Synthetic Polypeptide encoding a CAR with optional accessory module(s)
MTALFLMSMLFGLACGQAMSFCIPTEYTMHIERRECAYCLTINTTICAGYCMTRDINGKLFLPKYALSQDVCTYRDFIYRTVEIPGCPLHVAPYFSYPVALSCKCGKCNTDYSDCIHEAIKTNYCTKPQKSYLVGFSVGGGGSGGGGSGGGGSAPDVQDCPECTLQENPFFSQPGAPILQCMGCCFSRAYPTPLRSKKTMLVQKNVTSESTCCVAKSYNRVTVMGGFKVENHTACHCSTCYYHKSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6054 - protein, 1132 aa, Artificial Sequence
  Synthetic Polypeptide encoding a CAR with optional accessory module(s)
MALPVTALLLPLALLLHAARPQSVLTQPPSVSVSPGQTASITCSGDKLGDKYACWYQQKPGQSPVLVIYQDSKRPSGIPERFSGSNSGNTATLTISGTQAMDEADYYCQAWDSSTAVVFGGGTKLTVLGGGGSGGGGSGGGGSQVQLVQSGAEVKKPGQSLKISCKASGYSLTDNWIGWVRQKPGKGLEWMGIIYPGDSDTRYSPSFQGQVTISADKSINTAYLQWSSLKASDTAIYYCVGLDWNYNPLRYWGPGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6055 - protein, 1130 aa, Artificial Sequence
  Synthetic Polypeptide encoding a CAR with optional accessory module(s)
MALPVTALLLPLALLLHAARPDIVMTQSQKFMSTSVGDRVSIICKASQNVGTFVAWYQQKPGQSPKLLVYSASNRYTGVPDRFTGSGSGTDFTLTINNMQSEDLADYFCRQYSSYPYTFGGGTKLEIKGGGGSGGGGSGGGGSEVQLQQSGPELVKPGASMKISCKASGYSFSAYTMNWVKQSHGKNLEWIGLINPYNGGTNYNQEFEGKATLTVNKSSNTAFMELLSLTSDDSAVYYCARRDWDYFDYWGQGTTLTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6056 - protein, 1141 aa, Artificial Sequence
  Synthetic Polypeptide encoding a CAR with optional accessory module(s)
MALPVTALLLPLALLLHAARPAIQMTQSPSSLSASVGDRVTITCRASQSISNYLNWYQQKPGKAPKLLIYAASSLQSGVPSRFSGSGSGTDFTLTISSLQPEDFATYYCQQSYSSPSTTFGQGTKLEIKRGGGGSGGGGSGGGGSEVQLVESGGGLIQPGGSLRLSCAASGFTVSSNYMSWVRQAPGKGLEWVSVTYSGGSTSYADSVKGRFTISRDNSKNTLYLQMNSLRAEDTAVYYCARGGRYCSSISCYARSGCDYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6057 - protein, 1136 aa, Artificial Sequence
  Synthetic Polypeptide encoding a CAR with optional accessory module(s)
MALPVTALLLPLALLLHAARPDIQMTQSPSSLSASVGDRVTITCRASQSIGTSLHWYQQKPGKAPKLLIKFASRLQSGVPSRFSGSGSGTDFTLTISSLQPEDFATYYCQQSPGFPPTFGQGTKLEIKRGGGGSGGGGSGGGGSQVQLVESGGGLVKPGGSLRLSCAASGFSITTSGYYWTWIRQFPGKGLEWMGYIGYNSKTYYNPALKSRITISRDNAKNSLYLQMNSLRAEDTAVYYCARSLYGGYKDAFDSWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6058 - protein, 1141 aa, Artificial Sequence
  Synthetic Polypeptide encoding a CAR with optional accessory module(s)
MALPVTALLLPLALLLHAARPDEIVLTQSPLSLPVTPGEPASISCRSSQSLLHSIGYNYLDWYLQKPGQSPQLLIYLGSNRASGVPDRFSGSGSGTDFTLKISRVEAEDVGVYYCMQALQTPLTFGGGTKVEIKRGGGGSGGGGSGGGGSEVQLVESGGGVVQPGRSLRLSCAASGFTFRSYGMHWVRQAPGKGLEWVAVISYDGSNKYYTDSVNGRFTISRDNSKNTLYLQMNSLRAEDTAVYYCARGGGYYETSGPDYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6059 - protein, 1139 aa, Artificial Sequence
  Synthetic Polypeptide encoding a CAR with optional accessory module(s)
MALPVTALLLPLALLLHAARPDDVVMTQSPLSLPVTPGEPASISCRSSQSLLHSIGYNYLHWFLQKPGQSPQLLIYLGSNRASGVPDRFSGSGSGTDFTLKISRVEAEDVGVYYCMQALQTPPTFGQGTRLEIKRGGGGSGGGGSGGGGSQLQLQESGPGLVKPSGTLSLTCAVSGGSISSSNWWSWVRQPPGKGLEWIGEIYHSGSTNYNPSLKSRVTISVDKSKNQFSLKLSSVTAADTAVYYCVGSPYGDYVLDYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6060 - protein, 1142 aa, Artificial Sequence
  Synthetic Polypeptide encoding a CAR with optional accessory module(s)
MALPVTALLLPLALLLHAARPDVVMTQSPLSLPVTPGEPASISCRSSQSLLHSNGHNYLDWYLQKPGQSPQLLIYLGSNRASGVPDRFSGSGSGTDFTLKISRVEAEDVGVYYCMQTLQTPLTFGPGTKVDIKRGGGGSGGGGSGGGGSEVQLVETGGGVVQPGRSLRLSCAASGFTFSSYGMHWVRQAPGKGLEWVAVISYDGSNKYYADSVKGRFTISRDNSKNTLYLQMNSLRAEDTAVYYCAKDRYGWGSSFGHFDYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6061 - protein, 1137 aa, Artificial Sequence
  Synthetic Polypeptide encoding a CAR with optional accessory module(s)
MALPVTALLLPLALLLHAARPDEIVLTQSPGTLSLSLGERATLSCRASQSISSSFLAWYQQKPGQAPKLLIYAASTRATGIPDRFSGSGSGTDFTLTISRLEPEDFAVYYCQQYGRSLSFGGGTKVEVKGGGGSGGGGSGGGGSQVQLQQSGPGLVKPSQTLSLTCAISGDSVSGNSATWNWIRQSPSRGLEWLGRTYYRSKWNHDYAESVKSRITINPDTSKNQFSLQLNSVTPEDTAVYYCARGDSSSWYAFDYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6062 - protein, 1137 aa, Artificial Sequence
  Synthetic Polypeptide encoding a CAR with optional accessory module(s)
MALPVTALLLPLALLLHAARPDQTVVTQPPSASGTPGQRVTISCSGSSSNIGSNYVYWYQQLPGTAPKLLIYRSNQRPSGVPDRFSGSKSGTSASLAISGPRSVDEADYYCAAWDDSLNGVVFGGGTKLTVLGGGGGSGGGGSGGGGSQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARRIPPYYGMDVWGQGTTVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6063 - protein, 1137 aa, Artificial Sequence
  Synthetic Polypeptide encoding a CAR with optional accessory module(s)
MALPVTALLLPLALLLHAARPDQSVVTQPPSVSVAPGKTARITCGRNNIGSKSVHWYQQKPGQAPVLVVYDDSDRPSGIPERFSGSNSGNTATLTISRVEAGDEADYYCQVWDSSSDHVVFGGGTKLTVLGGGGGSGGGGSGGGGSEVQLVQSGGGVVRPGGSLRLSCAASGFTFDDYGMSWVRQAPGKGLEWVSGINWNGGSTGYADSVRGRFTISRDNAKNSLYLQMNSLRAEDTALYYCARERGYGYHDPHDYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6064 - protein, 1149 aa, Artificial Sequence
  Synthetic Polypeptide encoding a CAR with optional accessory module(s)
MALPVTALLLPLALLLHAARPEQKLISEEDLEFQAVVTQPPSASGTPGQRVTISCSGSSSNIGSNTVNWYQQVPGTAPKLLIYSNNQRPSGVPDRFSGSKSGTSASLAISGLQSEDEADYYCAAWDDSLNGWVFGGGTKLTVLGGGGSGGGGSGGGGSQMQLVQSGAEVKEPGESLRISCKGSGYSFTNFWISWVRQMPGKGLEWMGRVDPGYSYSTYSPSFQGHVTISADKSTSTAYLQWNSLKASDTAMYYCARVQYSGYYDWFDPWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6065 - protein, 1143 aa, Artificial Sequence
  Synthetic Polypeptide encoding a CAR with optional accessory module(s)
MALPVTALLLPLALLLHAARPEQKLISEEDLEFDIQMTQSPSTLSASVGDRVTITCRASQNINKWLAWYQQRPGKAPQLLIYKASSLESGVPSRFSGSGSGTEYTLTISSLQPDDFATYYCQQYNSYATFGQGTKVEIKRGGGGSGGGGSGGGGSQVQLVQSGAEVKKPGESLKISCKGSGYNFSNKWIGWVRQLPGRGLEWIAIIYPGYSDITYSPSFQGRVTISADTSINTAYLHWHSLKASDTAMYYCVRHTALAGFDYWGLGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6066 - protein, 1133 aa, Artificial Sequence
  Synthetic Polypeptide encoding a CAR with optional accessory module(s)
MALPVTALLLPLALLLHAARPEIVLTQSPGTLSLSPGERATLSCRASQSVSNTYLAWYHQRPGQAPRLLIYGASSRATGIPDRFSGSGSGTDFALTISSLEPEDFAVYYCQQYSNSWTFGQGTKVEIKRGGGGSGGGGSGGGGSQVQLVESGGGVVQPGRSLRLSCAASGFTFSSYDMHWVRQAPGKGLEWVAVISYDGTNEYYADSVKGRFTISRDTSKNTLYLQMNSLRAEDTAVYYCARERYFDWSFDYWGQGTLVSVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6067 - protein, 1132 aa, Artificial Sequence
  Synthetic Polypeptide encoding a CAR with optional accessory module(s)
MALPVTALLLPLALLLHAARPELTQDPAVSVALGQTVRITCQGDSLRSNYANWYQQKPGQAPVLVIYGQNNRPSGIPDRFSGSSSGNTASLTITGAQAADEADYYCDSRVSTGNHVVFGGGTKLTVLGQGGGGSGGGGSGGGGSEVQLVQSGAEVKKPGASVKVSCKASGYTFTSYAMHWVRQAPGQRLEWMGWINAGNGNTKYSQKFQGRVTITRDTSASTAYMELSSLRSEDTAVYYCARDISYGSFDYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6068 - protein, 1134 aa, Artificial Sequence
  Synthetic Polypeptide encoding a CAR with optional accessory module(s)
MALPVTALLLPLALLLHAARPDIVLTQTPATLSVTPGDSVSLSCRASQSISNNLHWYQQKSHESPRLLIKNASQSISGIPSKFSGSGSGTDFTLRINSVETEDFGMYFCQQSNSWPYTFGSGTKLEIKGGGGSGGGGSGGGGSQVKLQQSGPELVKPGASVKISCKASGYSFTGYYMHWVKQSHGNILDWIGYIYPYNGVSSYNQKFKGKATLTVDKSSSTAYMELRSLTSEDSAVYYCARERGLYQLRAMDYWGQGTSVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6069 - protein, 1125 aa, Artificial Sequence
  Synthetic Polypeptide encoding a CAR with optional accessory module(s)
MALPVTALLLPLALLLHAARPDIVMTQTPAIMSASPGQKVTITCSASSSVNYMHWYQQKLGSSPKLWIYDTSKLAPGVPARFSGSGSGTSYSLTISSMEAEDAASYFCHQWSSYPYTFGSGTKLEIKGGGGSGGGGSGGGGSEVQLQESGPDLVKPSQSLSLTCTVTGYSITSGYGWHWIRQFPGNKLEWMGYIHYSGSTTYNPSLKSRISISRDTSKNQFFLQLNSVTTEDTATYYCARSLRYWGQGTTLTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6070 - protein, 1128 aa, Artificial Sequence
  Synthetic Polypeptide encoding a CAR with optional accessory module(s)
MALPVTALLLPLALLLHAARPDIQMTQSPSSLSASVGDRVTITCSATSSISYMHWYQQKPGKAPKGWIYDTSKLAHGVPSRFSGSGSGTDFTLTISSLQPEDFATYYCHQRRSYPFTFGQGTKVEIKGGGGSGGGGSGGGGSEVQLVQSGAEVKKPGASVKVSCKASGYTFTNFWIHWVRQAPGQGLEWIGEIDPSDSYTNYNQKFKGRVTITRDTSTSTAYLELSSLRSEDTAVYYCAREITTVDYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6071 - protein, 1135 aa, Artificial Sequence
  Synthetic Polypeptide encoding a CAR with optional accessory module(s)
MALPVTALLLPLALLLHAARPDIQMTQSPSSLSASVGDRVTITCKASQGFNKYVAWYQQKPGKAPKLLIYYTSTLQPGVPSRFSGSGSGRDYTLTISSLQPEDFATYYCLQYGNLLYAFGQGTKVEIKRGGGGSGGGGSGGGGSEVQLVQSGAEVKKPGASVKVSCKASGYTFTSYWIGWVRQAPGQGLEWIGDIYPGGGYTNYNEKFKGRVTITRDTSTSTAYLELSSLRSEDTAVYYCARLDGSSYRGAMDSWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6072 - protein, 1139 aa, Artificial Sequence
  Synthetic Polypeptide encoding a CAR with optional accessory module(s)
MALPVTALLLPLALLLHAARPDIQLTQSPSSLSASVGDRVTITCRASQSVDYDGDSYMNWYQQKPGKAPKLLIYAASYLESGVPSRFSGSGSGTDFTLTISSLQPEDFATYYCQQSHEDPYTFGQGTKVEIKRGGGGSGGGGSGGGGSEVQLVESGGGLVQPGGSLRLSCAVSGYSITSGYSWNWIRQAPGKGLEWVASITYDGSTNYNPSVKGRITISRDDSKNTFYLQMNSLRAEDTAVYYCARGSHYFGHWHFAVWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6073 - protein, 1131 aa, Artificial Sequence
  Synthetic Polypeptide encoding a CAR with optional accessory module(s)
MALPVTALLLPLALLLHAARPDIQMTQSPSSLSASVGDRVTITCRASQDIRYYLNWYQQKPGKAPKLLIYVASSLQSGVPSRFSGSGSGTEFTLTVSSLQPEDFATYYCLQVYSTPRTFGQGTKVEIKGGGGSGGGGSGGGGSEVQLVESGGGLAKPGGSLRLSCAASGFRFTFNNYYMDWVRQAPGQGLEWVSRISSSGDPTWYADSVKGRFTISRENAKNTLFLQMNSLRAEDTAVYYCASLTTGSDSWGQGVLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6074 - protein, 1132 aa, Artificial Sequence
  Synthetic Polypeptide encoding a CAR with optional accessory module(s)
MALPVTALLLPLALLLHAARPEIVMTQSPATLSVSPGERATLSCRASQSVSRNLAWYQQKPGQAPRLLIYGASTRATGIPARFSGSGSGTEFTLTIGSLQSEDFAVYYCQQYKTWPRTFGQGTNVEIKGGGGSGGGGSGGGGSQVQLQQWGAGLLKPSETLSLTCAVFGGSFSGYYWSWIRQPPGKGLEWIGEINHRGNTNDNPSLKSRVTISVDTSKNQFALKLSSVTAADTAVYYCARERGYTYGNFDHWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6075 - protein, 1133 aa, Artificial Sequence
  Synthetic Polypeptide encoding a CAR with optional accessory module(s)
MALPVTALLLPLALLLHAARPEIVMTPSSATLSVSPGERATLSCRASQSVSRNLAWYQQKPGQAPRLLIYGASTRATGIPARFSGSGSGTEFTLTISSLQSEDFAVYYCHQYSNWMCSFGQGTKLEIKGGGGSGGGGSGGGGSEVQLLESGGGLVQPGGSLRLSCAASGFTFSRYAMNWVRQAPGKGLEWVSGISGSGGRTYYADSVKGRFTISRDNSKNTLYLQMNSLRAEDTAVYYCAKDRDFWSGPFDYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6076 - protein, 1133 aa, Artificial Sequence; identical to SEQ ID NO: 6075
  Synthetic Polypeptide encoding a CAR with optional accessory module(s)

SEQ ID NO: 6077 - protein, 1135 aa, Artificial Sequence
  Synthetic Polypeptide encoding a CAR with optional accessory module(s)
MALPVTALLLPLALLLHAARPQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSELVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6078 - protein, 1136 aa, Artificial Sequence
  Synthetic Polypeptide encoding a CAR with optional accessory module(s)
MALPVTALLLPLALLLHAARPEVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDKGGGYYDFWSGSDYWGQGTLVTVSSGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCNSRDSSGWVFGGGTKLTVLTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6079 - protein, 1145 aa, Artificial Sequence
  Synthetic Polypeptide encoding a CAR with optional accessory module(s)
MALPVTALLLPLALLLHAARPEVQLQQSGPGLVKPSQTLSLTCAISGDSVLSNSDTWNWIRQSPSRGLEWLGRTYHRSTWYDDYASSVRGRVSINVDTSKNQYSLQLNAVTPEDTGVYYCARDRLQDGNSWSDAFDVWGQGTMVTVSSGGGGSGGGGSGGGGSQSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTLVYVFGTGTKVTVLTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6080 - protein, 1143 aa, Artificial Sequence
  Synthetic Polypeptide encoding a CAR with optional accessory module(s)
MALPVTALLLPLALLLHAARPQVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARGDSNYWSYYGMDVWGQGTLVTVSSGGGGSGGGGSGGGGSGGGGSQSVLTQPRSVSGSPGQSVTISCTGTSSDVGGYNYVSWYQQHPGEAPKLIIYDADKRPSGISNRFSSGKSGNTASLTISGLQVEDEADYYCCSYAGGSTWVFGGGTKVTVLTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6081 - protein, 1145 aa, Artificial Sequence
  Synthetic Polypeptide encoding a CAR with optional accessory module(s)
MALPVTALLLPLALLLHAARPEVQLQQSGPGLVKPSQTLSLTCAISGDSVSSNSAAWNWIRQSPSRGLEWLGRTYYRSKWYSDYAVSVKSRITINPDTSKNQFSLQLNSVTPEDTAVYYCARDPYDFWSGYPDAFDIWGQGTMVTVSSGGGGSGGGGSGGGGSQSALTQPASVSGSPGQSITISCTGTSSDVGGYNYVSWYQQHPGKAPKVIISEVNNRPSGVSHRFSGSKSGNTASLTISGLQAEDEADYFCSSYTSGRTLYVFGTGSKVTVLGTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6082 - protein, 1144 aa, Artificial Sequence
  Synthetic Polypeptide encoding a CAR with optional accessory module(s)
MALPVTALLLPLALLLHAARPEVQLQQSGPGLVKPSQTLSLTCAISGDSMLSNSDTWNWIRQSPSRGLEWLGRTYHRSTWYDDYASSVRGRVSINVDTSKNQYSLQLNAVTPEDTGVYYCARVRLQDGNSWSDAFDVWGQGTMVTVSSGGGGSGGGGSGGGGSQSALTQPASASGSPGQSVTISCTGTSSDVGGYNYVSWYQQHPGKAPKLMIYDVSNRPSGVSNRFSGSKSGNTASLTISGLQAEDEADYYCSSYTSSSTLYVFGTGTQLTVLTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6083 - protein, 1135 aa, Artificial Sequence; identical to SEQ ID NO: 6077
  Synthetic Polypeptide encoding a CAR with optional accessory module(s)

SEQ ID NO: 6084 - protein, 1144 aa, Artificial Sequence
  Synthetic Polypeptide encoding a CAR with optional accessory module(s)
MALPVTALLLPLALLLHAARPDVMLTQTPLSLPVSLGDQASISCRSSQSILHSTGDTYLEWYLQKPGQSPKLLINKVSNRLSGVPDRFSGSGSGTDFTLKISRVEAEDLGVYYCFQGSHVPWTFGGGTKLEIKRADAAPTVSIFPGGGGSGGGGSGGGGSQVKLQQSGPSLVKPGASVKMSCKASGYTFTDFYMKWVKQSHGKSLEWIGDINPNIGDTFYNQKFKGKATLTVDKSSSTAYMQLNSLTSEDSAVYFCSVGYFDVWGAGTTVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6085 - protein, 1140 aa, Artificial Sequence
  Synthetic Polypeptide encoding a CAR with optional accessory module(s)
MALPVTALLLPLALLLHAARPEIVLTQSPATLSLSPGERATLSCRASQSVSIYLAWYQQKPGQAPRLLIYDASNRATGIPARFSGSGSGTDFTLTISSLEPEDFAVYYCQQRSNWPPFTFGPGTKVDIKGGGGSGGGGSGGGGSQVQLVESGGGVVQPGRSLRLSCAASGFTFSSYGMHWVRQAPGKGLEWVAVIWDDGSNKYYVDSVKGRFTISRDNSKNTLYLQMNSLRAEDTAVYYCARDDYYGSGSFNSYYGTDVWGQGTTVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6086 - protein, 1125 aa, Artificial Sequence
  Synthetic Polypeptide encoding a CAR with optional accessory module(s)
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKGGGGSGGGGSGGGGSEVQLVQSGGGLVHPGGSLRLSCAGSGFTFSTYLMYWVRQAPGKTLEWVSAIGSGGDTYYADSVKGRFTISRDNAKNSLYLQMNSLRAEDMAVYYCARGLGYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6087 - protein, 1144 aa, Artificial Sequence
  Synthetic Polypeptide encoding a CAR with optional accessory module(s)
MALPVTALLLPLALLLHAARPLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLGGGGSGGGGSGGGGSEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6088 - protein, 1134 aa, Artificial Sequence
  Synthetic Polypeptide encoding a CAR with optional accessory module(s)
MALPVTALLLPLALLLHAARPQSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSVFGTGTKVLVLGGGGSGGGGSGGGGSQVQLVQSGAEVKKPGSSVKVSCKASGGTFSSYTINVWRQAPGQGLEWMGGFIPISGTVNYAQKFQGRVTITADESTSTAYMELSSLRSEDTAVYYCARPLDWTEDIWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6089 - protein, 1137 aa, Artificial Sequence
  Synthetic Polypeptide encoding a CAR with optional accessory module(s)
MALPVTALLLPLALLLHAARPNFMLTQPHSVSESPGKTVTISCTGSSGSIASNYVQWYQQRPGSAPTILIYEDNKRPSGVPDRFSGSIDSSSNSASLTISGLKTGDEADYYCQSYDDINHWVFGGGTKLTVLGGGGGSGGGGSGGGGSEVQLVQSGAEVKKPGASVKVSCKASGYTFTAYYLHWLRQAPGQGLEWMGWMNTNNGATRYAQKFQDRVTMTRDTSINTAYMEMSGLSSDDTAMYYCARGDISQDFADVWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6090 - protein, 1129 aa, Artificial Sequence
  Synthetic Polypeptide encoding a CAR with optional accessory module(s)
MALPVTALLLPLALLLHAARPQIVLTQSPAIMSASPGEKVTITCSASSSVSYMHWFQQKPGTSPKLWIYSTSNLASGVPARFSGSGSGTSYSLTISRMEAEDAATYYCQQRSSYPPTFGGGTKLEIKGGGGSGGGGSGGGGSQVQLQQSGAELMKPGASVKISCKATGYTFSSYWIEWVKQRPGHGLEWIGEILPGSGSTNYNEKFKGKATFTADTSSNTAYMQLSSLTSEDSAVYYCARYDYPWFAYWGQGTLVTVSATRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6091 - protein, 1137 aa, Artificial Sequence
  Synthetic Polypeptide encoding a CAR with optional accessory module(s)
MALPVTALLLPLALLLHAARPDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPFTFGSGTKLEIKGGGGSGGGGSGGGGSQVQLQQPGAELVRPGASVKLSCKASGYTFTSYWINWVKQRPGQGLEWIGNIYPSDSYTNYNQKFKDKATLTVDKSSSTAYMQLSSPTSEDSAVYYCTRSWRGNSFDYWGQGTTLTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6092 - protein, 1135 aa, Artificial Sequence
  Synthetic Polypeptide encoding a CAR with optional accessory module(s)
MALPVTALLLPLALLLHAARPDTQMTQSPSSVSASVGDRVTITCRTSQDISNYLNWYQQKPGKAPKLLIYNTSRLHSGVPSRFSGSGSGTDFTLTISSLQPEDFATYYCQQSNMFPYTFGQGTKLEIKGGGGSGGGGSGGGGSQVQLVQSGAEVKKPGASVKVSCKASGYTFNGYFMNWVRQAPGQGLERMGRINPNNGDSFYNQKFQGRVTMTRDTSTSTVYMELPSLRSEDTAVYYCAREGYYGGRGYALDYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6093 - protein, 1140 aa, Artificial Sequence
  Synthetic Polypeptide encoding a CAR with optional accessory module(s)
MALPVTALLLPLALLLHAARPDIVMTQSPSSLAMSVGQKVTMTCKSSQSLLNSSNQKNYLAWYQQKPGQSPKLLVYFASTRESGVPDRFIGSGSGTDFTLTISSVQAEDLADYFCHQHYSTPLTFGAGTKLELKGGGGSGGGGSGGGGSEVQLQQSGPDLVKPGASVKMSCKASGYTFTSYVMHWVKQKPGQGLEWIGYIYPYNDGTKYNEKFKGKATLTSDKSSSTAYMELSSLTSEDSAVYYCAREEYGNYVRYFDVWGAGTTVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6094 - protein, 1134 aa, Artificial Sequence
  Synthetic Polypeptide encoding a CAR with optional accessory module(s)
MALPVTALLLPLALLLHAARPQSVVTQPPSVSAAPGQKVTISCSGSSSNIGNNYVSWYQQLPGTAPKLLIYDNNKRPSGIPDRFSASKSGTSATLGITGLQTRDEADYYCGTWDSSLSAWVFGGGTKLTVLGGGGGSGGGGSGGGGSQVQLVQSGAEVKKPGSSVKVSCKASGDTFSSYYISWVRQAPGQGLEWMGRIIPILGIANYAQKYQGRVTLSADKSTSTSYMELNSLSSEDTAVYYCALDWSYSIDYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6095 - protein, 1140 aa, Artificial Sequence
  Synthetic Polypeptide encoding a CAR with optional accessory module(s)
MALPVTALLLPLALLLHAARPEFEVKLVESGGGLVKFGGSLKLSCAASGFTLSSYYMSWVRQSPEKRLELVAVINSNGGSTYYPDTVKGRFTISRDNAKNTLYLQMSSLKSEDTALYYCARPFYYSNSPFAYWGQGTLVTVSAGGGGSGGGGSGGGGSDVLMTQTPLSLPVSLGDQASISCRSSQSIVHRTGNTYLEWYLQKPGQSPKLLIYKVSNRFSGVPDRFSGSGSGTDFTLKISRVGAEDLGVYYCFQGSHVPYTFGGGTKLEIKTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6096 - protein, 1137 aa, Artificial Sequence
  Synthetic Polypeptide encoding a CAR with optional accessory module(s)
MALPVTALLLPLALLLHAARPELVMTQSPASLAVSLGQRATISCRASESVDSYGKSFMHWYQLKPGQPPKLLIYRASNLESGVPARFSGSGSRTDFTLTIDPVEADDAATYYCQQNNEDPWTFGGGTKLEIKGGGGSGGGGSGGGGSEVQLEQSGPELVKPGASVKMSCKASGYTFTNYYMKWVKQSHGKSLEWIGDLNPNNGDTFYNQKFKGKATLTVDKSSNTAYMQLNSLTSEDSAVYYCARTGRYEENAMDYWGQGTSVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6097 - protein, 1131 aa, Artificial Sequence
  Synthetic Polypeptide encoding a CAR with optional accessory module(s)
MALPVTALLLPLALLLHAARPDVVMTQSPSSLSASVGDRVTITCMASEDIYIRLAWYQQKPGNAPKLLIYAATSLETGVPSRFSGSGSGTDFTLTISSLQPEDFATYYCQQYWSSPWTFGGGTKVEIKGGGGSGGGGSGGGGSQVQLQESGPGLVKPSQTLSLTCTVSGYSITSDYTWNWIRQPPGNGLEWIGYITYSGSTSYNPSLKSRVLISVDTSKNQVSLKLSSVTAADTAVYYCARLGRRYTMDYWGQGTTVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6098 - protein, 1138 aa, Artificial Sequence
  Synthetic Polypeptide encoding a CAR with optional accessory module(s)
MALPVTALLLPLALLLHAARPDVLMTQTPVSLSVSLGDQASISCRSSQSIVHSTGNTYLEWYLQKPGQSPKLLIYKISNRFSGVPDRFSGSGSGTDFTLKISRVEAEDLGVYYCFQASHAPRTFGGGTKLEIKRGGGGSGGGGSGGGGSEVILVESGGGLVKPGGSLKLSCAASGFTFSSYTMSWVRQTPEKRLEWVATISSGGGNTYYPDSVKGRFTISRDNAKNNLYLQMSSLRSEDTALYYCARYYRYEAWFASWGQGTLVTVSATRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6099 - protein, 1008 aa, Artificial Sequence
  Synthetic Polypeptide encoding a CAR with optional accessory module(s)
MALPVTALLLPLALLLHAARPQVKLEESGGGLVQAGRSLRLSCAASEHTFSSHVMGWFRQAPGKERESVAVIGWRDISTSYADSVKGRFTISRDNAKKTLYLQMNSLKPEDTAVYYCAARRIDAADFDSWGQGTQVTVSSDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6100 - protein, 1007 aa, Artificial Sequence
  Synthetic Polypeptide encoding a CAR with optional accessory module(s)
MALPVTALLLPLALLLHAARPEVQLVESGGGLVQAGGSLRLSCAASGRTFTMGWFRQAPGKEREFVAAISLSPTLAYYAESVKGRFTISRDNAKNTVVLQMNSLKPEDTALYYCAADRKSVMSIRPDYWGQGTQVTVSSDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6101 - protein, 1141 aa, Artificial Sequence
  Synthetic Polypeptide encoding a CAR with optional accessory module(s)
MALPVTALLLPLALLLHAARPQVKLEESGGGLVQAGRSLRLSCAASEHTFSSHVMGWFRQAPGKERESVAVIGWRDISTSYADSVKGRFTISRDNAKKTLYLQMNSLKPEDTAVYYCAARRIDAADFDSWGQGTQVTVSSGGGGSGGGGSGGGGSEVQLVESGGGLVQAGGSLRLSCAASGRTFTMGWFRQAPGKEREFVAAISLSPTLAYYAESVKGRFTISRDNAKNTVVLQMNSLKPEDTALYYCAADRKSVMSIRPDYWGQGTQVTVSSDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6102 - protein, 1005 aa, Artificial Sequence
  Synthetic Polypeptide encoding a CAR with optional accessory module(s)
MALPVTALLLPLALLLHAARPEVQLVESGGGLVQAGGSLRLSCIATGKVFSIYDMGWYRQAPGKQRELVAEITSSGTTHYDDFVSGRFTISRDNAKNTVYLQMNTLKAEDTAVYYCRANHVFGGSYWGQGTQVTVSSDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6103 - protein, 1011 aa, Artificial Sequence
  Synthetic Polypeptide encoding a CAR with optional accessory module(s)
MALPVTALLLPLALLLHAARPQVQLVESGGGLVQPGGSLRLSCEASGFTLDYYAIGWFRQAPGKEREGVICISRSDGSTYYADSVKGRFTISRDNAKKTVYLQMISLKPEDTAAYYCAAGADCSGYLRDYEFRGQGTQVTVSSDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6104 - protein, 1134 aa, Artificial Sequence
  Synthetic Polypeptide encoding a CAR with optional accessory module(s)
MALPVTALLLPLALLLHAARPEVQLVESGGGLVQAGGSLRLSCIATGKVFSIYDMGWYRQAPGKQRELVAEITSSGTTHYDDFVSGRFTISRDNAKNTVYLQMNTLKAEDTAVYYCRANHVFGGSYWGQGTQVTVSSEVAALEKQVQLVESGGGLVQPGGSLRLSCEASGFTLDYYAIGWFRQAPGKEREGVICISRSDGSTYYADSVKGRFTISRDNAKKTVYLQMISLKPEDTAAYYCAAGADCSGYLRDYEFRGQGTQVTVSSDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6105 - protein, 1017 aa, Artificial Sequence
  Synthetic Polypeptide encoding a CAR with optional accessory module(s)
MALPVTALLLPLALLLHAARPQVKLEESGGRLVQPRGSLRLSCAGSGRTFSTYGMAWFRQAPGKEREFVASKASMNYSGRTYYADSVKGRFTIARDNAKNMVFLQMNNLKPEDTAVYYCAAGTGCSTYGCFDAQIIDYWGKGTLVTVSSDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6106 - protein, 1008 aa, Artificial Sequence
  Synthetic Polypeptide encoding a CAR with optional accessory module(s)
MALPVTALLLPLALLLHAARPQVKLEESGGGLVQPGESLRLSCSASGSIFKVFRVFAMSWYRQGPGKQRELVASISSGETTTYADSVKGRFTISRDNAKNTAYLQMDSLKPEDTAVYYCNADHTFTGDFWGQGTQVTVSSDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6107 - protein, 1143 aa, Artificial Sequence
  Synthetic Polypeptide encoding a CAR with optional accessory module(s)
MALPVTALLLPLALLLHAARPQVKLEESGGRLVQPRGSLRLSCAGSGRTFSTYGMAWFRQAPGKEREFVASKASMNYSGRTYYADSVKGRFTIARDNAKNMVFLQMNNLKPEDTAVYYCAAGTGCSTYGCFDAQIIDYWGKGTLVTVSSEVAALEKQVKLEESGGGLVQPGESLRLSCSASGSIFKVFRVFAMSWYRQGPGKQRELVASISSGETTTYADSVKGRFTISRDNAKNTAYLQMDSLKPEDTAVYYCNADHTFTGDFWGQGTQVTVSSDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6108 - protein, 1006 aa, Artificial Sequence
  Synthetic Polypeptide encoding a CAR with optional accessory module(s)
MALPVTALLLPLALLLHAARPQVKLEESGGELVQPGGPLRLSCAASGNIFSINRMGWYRQAPGKQRAFVASITVRGITNYADSVKGRFTISVDKSKNTIYLQMNALKPEDTAVYYCNAVSSNRDPDYWGQGTQVTVSSDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6109 - protein, 1018 aa, Artificial Sequence
  Synthetic Polypeptide encoding a CAR with optional accessory module(s)
MALPVTALLLPLALLLHAARPPVQLVESGGGLVQAGDSLRLSCAASGRTFGIGTMGWFRQPPGKEREFVAAIRWSTGGTRYADSVKGRFTISRDNAKLTVDLQMDSLKPEDTAVYYCAADRLSLDLSGRYHYNPAVYDYWGQGTQVTVSSDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6110 - protein, 1150 aa, Artificial Sequence
  Synthetic Polypeptide encoding a CAR with optional accessory module(s)
MALPVTALLLPLALLLHAARPQVKLEESGGELVQPGGPLRLSCAASGNIFSINRMGWYRQAPGKQRAFVASITVRGITNYADSVKGRFTISVDKSKNTIYLQMNALKPEDTAVYYCNAVSSNRDPDYWGQGTQVTVSSGGGGSGGGGSGGGGSPVQLVESGGGLVQAGDSLRLSCAASGRTFGIGTMGWFRQPPGKEREFVAAIRWSTGGTRYADSVKGRFTISRDNAKLTVDLQMDSLKPEDTAVYYCAADRLSLDLSGRYHYNPAVYDYWGQGTQVTVSSDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6111 - protein, 1008 aa, Artificial Sequence
  Synthetic Polypeptide encoding a CAR with optional accessory module(s)
MALPVTALLLPLALLLHAARPAVQLVESGGGLVQAGDSLRLTCTASGRAFSTYFMAWFRQAPGKEREFVAGIAWSGGSTAYADSVKGRFTISRDNAKNTVYLQMNSLKSEDTAVYYCASRGIEVEEFGAWGQGTQVTVSSDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6112 - protein, 1009 aa, Artificial Sequence
  Synthetic Polypeptide encoding a CAR with optional accessory module(s)
MALPVTALLLPLALLLHAARPQVQLVESGGGLVQAGGSLRLSCAASGGTLSKNTVAWFRQAPGKERGFVASITWDGRTTYYADSVKGRFTISRDNAKNTVYLQMNSLKPEDTAVYVCADLGKWPAGPADYWGQGTQVTVSSDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6113 - protein, 1135 aa, Artificial Sequence
  Synthetic Polypeptide encoding a CAR with optional accessory module(s)
MALPVTALLLPLALLLHAARPAVQLVESGGGLVQAGDSLRLTCTASGRAFSTYFMAWFRQAPGKEREFVAGIAWSGGSTAYADSVKGRFTISRDNAKNTVYLQMNSLKSEDTAVYYCASRGIEVEEFGAWGQGTQVTVSSPGGGGSPQVQLVESGGGLVQAGGSLRLSCAASGGTLSKNTVAWFRQAPGKERGFVASITWDGRTTYYADSVKGRFTISRDNAKNTVYLQMNSLKPEDTAVYVCADLGKWPAGPADYWGQGTQVTVSSDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6114 - protein, 1163 aa, Artificial Sequence
  Synthetic Polypeptide encoding a CAR with optional accessory module(s)
MALPVTALLLPLALLLHAARPAVQLVESGGGLVQAGDSLRLTCTASGRAFSTYFMAWFRQAPGKEREFVAGIAWSGGSTAYADSVKGRFTISRDNAKNTVYLQMNSLKSEDTAVYYCASRGIEVEEFGAWGQGTQVTVSSPGGGGSPQVQLVESGGGLVQAGGSLRLSCAASGGTLSKNTVAWFRQAPGKERGFVASITWDGRTTYYADSVKGRFTISRDNAKNTVYLQMNSLKPEDTAVYVCADLGKWPAGPADYWGQGTQVTVSSEVAALEKEVAALEKEVAALEKEVAALEKDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6115 - protein, 1137 aa, Artificial Sequence
  Synthetic Polypeptide encoding a CAR with optional accessory module(s)
MALPVTALLLPLALLLHAARPEIVLTQSPATLSLSPGERATLSCSASSSVSYMYWYQQKPGQAPRLLIYRTSNLASGIPARFSGSGSGTDFTLTISSLEPEDFAVYYCQQYHSYPTTFGQGTKVEIKRTVGGGGSGGGGSGGGGSEVQLVESGGGLVQPGGSLRLSCAASGFSFNTYAMNWVRQAPGKGLEWVSHIRSKSNNFATYYADSVKDRFTISRDNAKNSLYLQMNSLRAEDTAVYYCARQGGDFPMDYWGQGTLVTVSSTRTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6116 - protein, 1131 aa, Artificial Sequence
  Synthetic Polypeptide encoding a CAR with optional accessory module(s)
MALPVTALLLPLALLLHAARPDVVMTQSPSSLSASVGDRVTITCKASEDIYIRLAWYQQKPGKAPKLLIYAATSLETGVPSRFSGSGSGTDFTLTISSLQPEDFATYYCQQYWTTPWTFGGGTKVEIKGGGGSGGGGSGGGGSQVQLQESGPGLVKPSQTLSLTCTVSGYSITIDYTWNWIRQPPGKGLEWIGYITYSGSTDYNPSLKSRVLISVDTSKNQVSLKLSSVTAADTAVYYCARLGRRYALDYWGQGTTVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6117 - protein, 1136 aa, Artificial Sequence
  Synthetic Polypeptide encoding a CAR with optional accessory module(s)
MALPVTALLLPLALLLHAARPDIQLTQSPSFLSASVGDRVTITCRASQGISTDLNWYQQKPGKAPKLLIYAASNLESGVPSRFSGSGSGTEFTLTISSLQPEDFATYYCQQSYNWPYTFGGGTKVEIKRGGGGSGGGGSGGGGSEVQLVESGGGLVKPGGSLRLSCAASGFTFSNFEMNWVRQAPGKGLEWVSGISSNGRYINYADSVKGRFTISRDNAKNSLYLQMNSLRAEDTAVYYCARVVDFDQDYNGFDYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6118 - protein, 1134 aa, Artificial Sequence
  Synthetic Polypeptide encoding a CAR with optional accessory module(s)
MALPVTALLLPLALLLHAARPDIQLTQSPSFLSASVGDRVTITCSLSLGISTWRDWFPPRLGRGLEPLTYAASTLQSGVPSRFSGSGSGTEFTLTISSLQPEDFATYYCQQLNSYPLTFGGGTKVEIKRGGGGSGGGGSGGGGSEVQLVESGGGLVKPGGSLRLSCAASGFTFSTYGMSWVRQAPGKGLEWVAYINNGSGYIYYADSVKGRFTISRDNAKNSLYLQMNSLRAEDTAVYYCARGQWWSGGDFDYWGQGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRISRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6119 - protein, 1098 aa, Artificial Sequence
  Synthetic Polypeptide encoding a CAR with optional accessory module(s)
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSRVFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6120 - protein, 1098 aa, Artificial Sequence
  Synthetic Polypeptide encoding a CAR with optional accessory module(s)
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6121 - protein, 1098 aa, Artificial Sequence
  Synthetic Polypeptide encoding a CAR with optional accessory module(s)
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6122 - protein, 1099 aa, Artificial Sequence
  Synthetic Polypeptide encoding a CAR with optional accessory module(s)
MALPVTALLLPLALLLHAARPDEIVLTQSPATLSLSPGERATLSCSASSSVSYMHWYQQKPGQAPRLLIYDTSKLASGIPARFSGSGSGTDFTLTISSLEPEDVAVYYCFQGSVYPFTFGQGTKLEIKRGGGGSGGGGSGGGGSQVQLQESGPGLVKPSQTLSLTCTVSGGSISTSGMGVGWIRQHPGKGLEWIGHIWWDDDKRYNPALKSRVTISVDTSKNQFSLKLSSVTAADTAVYYCARMELWSYYFDYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6123 - protein, 1106 aa, Artificial Sequence
  Synthetic Polypeptide encoding a CAR with optional accessory module(s)
MALPVTALLLPLALLLHAARPDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6124 - protein, 1105 aa, Artificial Sequence
  Synthetic Polypeptide encoding a CAR with optional accessory module(s)
MALPVTALLLPLALLLHAARPDIVMTQAAPSIPVTPGESVSISCRSSKSLLNSNGNTYLYWFLQRPGQSPQLLIYRMSNLASGVPDRFSGSGSGTAFTLRISRVEAEDVGVYYCMQHLEYPFTFGAGTKLELKRGGGGSGGGGSGGGGSEVQLQQSGPELIKPGASVKMSCKASGYTFTSYVMHWVKQKPGQGLEWIGYINPYNDGTKYNEKFKGKATLTSDKSSSTAYMELSSLTSEDSAVYYCARGTYYYGSRVFDYWGQGTTLTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6125 - protein, 1103 aa, Artificial Sequence
  Synthetic Polypeptide encoding a CAR with optional accessory module(s)
MALPVTALLLPLALLLHAARPEIVLTQSPDFQSVTPKEKVTITCRASESVDTFGISFMNWFQQKPDQSPKLLIHAASNQGSGVPSRFSGSGSGTDFTLTINSLEAEDAATYYCQQSKEVPFTFGGGTKVEIKGGGGSGGGGSGGGGSEVQLVESGGGLVQPGGSLRLSCAASGFTFSSSWMNWVRQAPGKGLEWVGRIYPGDGDTNYNGKFKGRFTISRDDSKNSLYLQMNSLKTEDTAVYYCARSGFITTVLDFDYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6126 - protein, 1099 aa, Artificial Sequence
  Synthetic Polypeptide encoding a CAR with optional accessory module(s)
MALPVTALLLPLALLLHAARPAIQLTQSPSSLSASVGDRVTITCRASQGISSAQQKPGKAPKLLILAWYSSLESGVPSRFSGYDASGSGTDFTLTISSLQPEDFATYYCQQFNSYPYTFGQGTKLEIKGGGGSGGGGSGGGGSEVQLVQSGAEVKKPGESLKISCKGSGYSFSSSWIGWVRQMPGKGLEWMGIIYPDDSDTRYSPSFQGQVTISADKSIRTAYLQWSSLKASDTAMYYCARHVTMIWGVIIDFWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6127 - protein, 1123 aa, Artificial Sequence
  Synthetic Polypeptide encoding a CAR with optional accessory module(s)
MALPVTALLLPLALLLHAARPINIYNAEPANPSEKNSPEFDIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIKGGGGSGGGGSGGGGSEVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6128 - protein, 1105 aa, Artificial Sequence
  Synthetic Polypeptide encoding a CAR with optional accessory module(s)
MALPVTALLLPLALLLHAARPDILLTQSPATLSLSPGERATLSCRASQSVDYDGDSYLNWYQQKPGQPPKLLIYDASNLVSGIPPRFSGSGSGTDFTLTISRLEPEDFAVYHCQQSTEDPWTFGGGTKLEIKGGGGSGGGGSGGGGSQVQLVESGGGLVEPGGSLRLSCMSGYAFSSYWMNWVRQMPGKGLEWMGQIWPGDGDTNYNPSLKSRVTITADESTSTAYMELSSLKAEDTAVYFCARRETTTVGRYYYAMDYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6129 - protein, 1102 aa, Artificial Sequence
  Synthetic Polypeptide encoding a CAR with optional accessory module(s)
MALPVTALLLPLALLLHAARPDILLTQSPATLSLSPGERATLSCRASQSVDNYGISFMNWYQQKPGQPPKLLIYAASNQGSGIPSRFSGSGSGTDFTLTISSLEPEDFAMYFCQQSNEVPRTFGGGTKLEIKGGGGSGGGGSGGGGSQVQLVESGGGLVEPGGSLRLSCMSGYAFSSSWMNWVRQMPGKGLEWMGRIYPGDGDTNYNGKFKERVTITADESTSTAYMELSSLKAEDTAVYFCARSEYWGNYWAMDYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6130 - protein, 1101 aa, Artificial Sequence
  Synthetic Polypeptide encoding a CAR with optional accessory module(s)
MALPVTALLLPLALLLHAARPDILLTQSPATLSLSPGERATLSCKASQNVGTNVAWYQQKPGQPPKLLIYSATYRNSGIPARFSGSGSGTEFTLTITNVQSKDLADYFYFCQYNRYPYTSGGGTKLEIKRGGGGSGGGGSGGGGSQVQLVESGGGLVEPGGSLRLSCMSGYAFSSYWMNWVRQMPGKGLEWMGQIYPGDGDTNYNGKFKGRVTITADESTSTAYMELSSLKAEDTAVYFCARKTISSVVDFYFDNWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6131 - protein, 1114 aa, Artificial Sequence
  Synthetic Polypeptide encoding a CAR with optional accessory module(s)
MALPVTALLLPLALLLHAARPINIYNAEPANPSEKNSPEFQIVLTQSPATLSASPGEKATMTCSASSGVNYMHWYQQKPGTSPKRWIYDTDKTASGVPARFSGSGSGTSYSLTISSMEAEDAATYYCHQRGSYTFGGGTKLEIKGGGGSGGGGSGGGGSQVQLEQPGAEVVKPGASVKVSCKTSGYTFTSNWMHWVKQTPGKGLEWIGEIDPSDSYTNYNQKFDGKAKLTVDKSSSTAYMEVSDLTAEDSATYYCARGSNPYYYAMDYWGQGTSVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6132 - protein, 1100 aa, Artificial Sequence
  Synthetic Polypeptide encoding a CAR with optional accessory module(s)
MALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRGGGGSGGGGSGGGGSQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6133 - protein, 1108 aa, Artificial Sequence
  Synthetic Polypeptide encoding a CAR with optional accessory module(s)
MALPVTALLLPLALLLHAARPDDIQLTQSPSSLSASVGDRVTITCKASQSVDYDGDSYLNWYQQIPGKAPKLLIYDASNLVSGIPPRFSGSGSGTDYTFTISSLQPEDIATYHCQQSTEDPWTFGGGTKLQIKRGGGGSGGGGSGGGGSQVQLQQSGAEVKKPGSSVKVSCKASGYAFSSYWMNWVRQRPGQGLEWIGQIWPGDGDTNYNGKFKGRATITADESTNTAYMELSSLRSEDTAFYSCARRETTTVGRYYYAMDYWGQGTTVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6134 - protein, 1099 aa, Artificial Sequence
  Synthetic Polypeptide encoding a CAR with optional accessory module(s)
MALPVTALLLPLALLLHAARPQSVLTQPASVSGSPGQSITISCTGTSSDVGGYNYVSWYQQHPGKAPKLMIYDVNNRPSEVSNRFSGSKSGNTASLTISGLQAEDEADYYCSSYTTGSRAVFGGGTKLTVLGGGGGSGGGGSGGGGSEVQLVQSGAEVKKPGESLTISCKASGYSFPNYWITWVRQMSGGGLEWMGRIDPGDSYTTYNPSFQGHVTISIDKSTNTAYLHWNSLKASDTAMYYCARYYVSLVDIWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6135 - protein, 1105 aa, Artificial Sequence
  Synthetic Polypeptide encoding a CAR with optional accessory module(s)
MALPVTALLLPLALLLHAARPQSVVTQPPSVSAAPGQKVTISCSGSSSNIGNNYVSWYQQLPGTAPKLLIYDNNKRPSGIPDRFSGSKSGTSATLGITGLQTGDEADYYCGTWDGSLYTMLFGGGTKLTVLGGGGSGGGGSGGGGSEVQLVESGGGLVKPGGSLRLSCAASGFTFSNAWMSWVRQAPGKGLEWVGFIRSKAYGGTTEYAASVKGRFTISRDDSKSIAYLQMNNLKTEDTAVYYCARDGLYSSSWYDSDYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6136 - protein, 1110 aa, Artificial Sequence
  Synthetic Polypeptide encoding a CAR with optional accessory module(s)
MALPVTALLLPLALLLHAARPQSVLTQPPSVSGAPGQRVTISCTGSSSNIGAGYDVHWYQQLPGTAPKLLIFGNSNRPSGVPDRFSGFKSGTSASLAITGLQAEDEADYFCQSYDSSLSGSGVFGTGTKVTVLGGGGGSGGGGSGGGGSQMQLVQSGGGLVQPGRSLRLSCAASGFTFDDYAMHWVRQAPGKGLEWVSGISWNSGSIGYADSVKGRFTISRDNAKNSLYLQMNSLRAEDTALYYCAKDIHSGSYYGLLYYAMDVWGQGTTVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6137 - protein, 1097 aa, Artificial Sequence
  Synthetic Polypeptide encoding a CAR with optional accessory module(s)
MALPVTALLLPLALLLHAARPDYIHVTQSPSSLSVSIGDRVTINCQTSQGVGSDLHWYQHKPGRAPKLLIHHASSVEDGVPSRFSGTGFHTSFNLTINDLQADDIGTYYCQVLQSFGRGSRLDTKGGGGSGGGGSGGGGSRAHLVQSGTAMKKPGASVRVSCQTSGYTFTAHILFWFRQAPGRGLEWVGWIKPQYGAVNFGGGFRDRVTLTRDVYREIAYMDIRGLKPDDTAVYYCARDRSYGDSSWALDAWGQGTTVVVSATRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6138 - protein, 1107 aa, Artificial Sequence
  Synthetic Polypeptide encoding a CAR with optional accessory module(s)
MALPVTALLLPLALLLHAARPDVQMIQTPDSLAVSLGQRATISCRASESVDNYGISFMHWYQQKPGQSPKLLIYRASNLESGIPARFSGSGSRTDFTLTINPVETDDVATYYCQQNNKDPPTFGGGTKLEIKGGGGSGGGGSGGGGSGGGGSQVQLQQSGAELVKPGASVKISCKASGYAFSSYWMNWVKQRPGKGLEWIGQIYPGDGDTTYNGKFKGKATLTADKSSSTVYMQLNSLTSEDSAVYFCVRYYYGSSGYFDYWGQGTTLTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6139 - protein, 1098 aa, Artificial Sequence
  Synthetic Polypeptide encoding a CAR with optional accessory module(s)
MALPVTALLLPLALLLHAARPDVQMIQTPSSLSASLGDRVTISCRASQDIGNYLNWYQQKPDGTVKLLIYYTSRLHSGVPSRFSGSGSGTEYSLTISNLEQEDIATYFCQQGSALPPTFGGGTKLEINGGGGSGGGGSGGGGSALQLQQSGAELVRPGASVTLSCKASGYTFTDYEMHWVKQTPVHGLEWIGAIDPETGGTAYNQKFEGKAILTADKSSSTAYMELRSLTSEDSPVYYCARRRYYGSSSFDYWGQGTTLTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6140 - protein, 1105 aa, Artificial Sequence
  Synthetic Polypeptide encoding a CAR with optional accessory module(s)
MRLPAQLLGLLMLWVSGSSGDVVMTQSPLSLPVTPGAPASISCRSSQSIVHSNGNTYLEWYLQKPGQSPKLLIYKVSNRFSGVPDRFSGSGSGTDFTLRISRVEAEDVGIYYCFQGSHVPPTFGPGTKLEIKGGGGSGGGGSGGGGSEVQLVESGGGLVQPGGSLRLSCSASGFTFSSFGMHWVRQAPGKGLEWVAYISSGSSTIYYGDTVKGRFTISRDNAKNSLFLQMSSLRAEDTAVYYCAREGGYYYGRSYYTMDYWGQGTTVTVSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6141 - protein, 1130 aa, Artificial Sequence
  Synthetic Polypeptide encoding a CAR with optional accessory module(s)
MALPVTALLLPLALLLHAARPARKRTQPTFGFTVNWKFSESTTVFTGQCFIDRNGKEVLKTMWLLRSSVNDIGDDWKATRVGINIFTRLRTQKEGGSGGSARKCSLTGKWTNDLGSNMTIGAVNSRGEFTGTYITAVTATSNEIKESPLHGTQNTINKSGGSTTVFTGQCFIDRNGKEVLKTMWLLRSSVNDIGDDWKATRVGINIFTRLRTQKEGGSGGSARKCSLTGKWTNDLGSNMTIGAVNSRGEFTGTYITAVTATSNEIKESPLHGTQNTINKRTQPTFGFTVNWKFSETRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6142 - protein, 1102 aa, Artificial Sequence
  Synthetic Polypeptide encoding a CAR with optional accessory module(s)
MALPVTALLLPLALLLHAARPDIVLTQSPASLAVSLGQRATISCRASKSVSTSGYSYLHWYQQKPGQPPKLLIYLASNLESGVPARFSGSGSGTDFTLNIHPVEEEDAATYYCQHSRELPFTFGSGTKLEIKGGGGSGGGGSGGGGSQVQLVESGGGLVQPGGSLKLSCAASGFDFSRYWMSWVRQAPGKGLEWIGEINPTSSTINFTPSLKDKVFISRDNAKNTLYLQMSKVRSEDTALYYCARGNYYRYGDAMDYWGQGTSVTVSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6143 - protein, 1100 aa, Artificial Sequence
  Synthetic Polypeptide encoding a CAR with optional accessory module(s)
MALPVTALLLPLALLLHAARPDIQMTQSPSSLSASVGDRVTITCSASQDISNYLNWYQQKPGKAPKLLIYYTSNLHSGVPSRFSGSGSGTDFTLTISSLQPEDFATYYCQQYRKLPWTFGQGTKLEIKRGGGGSGGGGSGGGGSQVQLVQSGAEVKKPGSSVKVSCKASGGTFSNYWMHWVRQAPGQGLEWMGATYRGHSDTYYNQKFKGRVTITADKSTSTAYMELSSLRSEDTAVYYCARGAIYDGYDVLDNWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6144 - protein, 1100 aa, Artificial Sequence
  Synthetic Polypeptide encoding a CAR with optional accessory module(s)
MALPVTALLLPLALLLHAARPDIVLTQSPATLSLSPGDRATISCRASESVTILGSHLIYWYQQKPGQPPRLLIQLASNVQTGVPARFSGSGSRTDFTLTISSVEPEDFAVYYCLQSRTIPRTFGQGTKLEIKRGGGGSGGGGSGGGGSQVQLVQSGPEVKKPGESVKISCKASGYTFRHYSMNWVKQAPGQGLKWMGRINTESGVPIYADDFKGRFSFTVDTSASTAYLEISSLTSEDTAVYFCSNDYLYSLDFWGQGTTLTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6145 - protein, 1101 aa, Artificial Sequence
  Synthetic Polypeptide encoding a CAR with optional accessory module(s)
MALPVTALLLPLALLLHAARPQSVLTQPPSVSGAPGQRVTISCTGSSSNIGAGFDVHWYQQLPGTAPKLLIYGNSNRPSGVPDRFSGSKSGTSASLAITGLQAEDEADYYCQSYDSSLSGYVFGTGTKVTVLGGGGGSGGGGSGGGGSQVQLVQSGAEVKKPGASVKVSCKASGYTFTDYYMHWVRQAPGQRLEWMGWINPNSGGTNYAQKFQDRITVTRDTSSNTGYMELTRLRSDDTAVYYCARSPYSGVLDKWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6146 - protein, 1099 aa, Artificial Sequence
  Synthetic Polypeptide encoding a CAR with optional accessory module(s)
MALPVTALLLPLALLLHAARPQAVLTQPPSASGTPGQRVTISCSGSSSNIGSYTVSWYQQLPGTAPKFLIYSNNQRPSGVPDRFSGSKSGTSASLAISGLQSEDEADYYCAAWDDSLNGYVFGTGTKVTVLGGGGGSGGGGSGGGGSEVQLVQSGAEVKKPGESLKISCKGSGYDFTTYWIGWVRQMPGKGLEWMGIIYPGDSDTRYSPSVRGRVTISADKSINTAYLQWSSLEASDTAMYYCARMWTFSQDGWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6147 - protein, 1110 aa, Artificial Sequence
  Synthetic Polypeptide encoding a CAR with optional accessory module(s)
MALPVTALLLPLALLLHAARPLPVLTQPPSASGTPGQRVTISCSGRSSNIGSNSVNWYRQLPGAAPKLLIYSNNQRPPGVPVRFSGSKSGTSASLAISGLQSEDEATYYCATWDDNLNVHYVFGTGTKVTVLGSRGGGGSGGGGSGGGGSLEMAQVQLVQSGAEVKKPGSSVKVSCKASGGTFSSYAISWVRQAPGQGLEWMGRIIPILGIANYAQKFQGRVTITADKSTSTAYMELSSLRSEDTAVYYCARGGYYSHDMWSEDWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6148 - protein, 1099 aa, Artificial Sequence
  Synthetic Polypeptide encoding a CAR with optional accessory module(s)
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRIFPRTFGQGTKLEIKGGGGSGGGGSGGGGSQVQLVQSGSELKKPGESVKISCKASGYTFTDYSINWVKQAPGQGLKWMGWINTETREPAYAYDFRGRFVFSLDTSASTAYLQISSLKAEDTAVYFCALDYSYAMDYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6149 - protein, 1100 aa, Artificial Sequence
  Synthetic Polypeptide encoding a CAR with optional accessory module(s)
MALPVTALLLPLALLLHAARPDIVLTQSPATLSLSPGDRATLSCRASESVTILGSHLIYWYQQKPGQAPRLLIQLASNVQTGIPARFSGSGSRTDFTLTISSLEPEDFAVYYCLQSRTIPRTFGQGTKLEIKRGGGGSGGGGSGGGGSQVQLVQSGSELKKPGESVKISCKASGYTFTHYSMNWVRQAPGQGLEWMGRINTETGEPLYADDFKGRFVFSLDTSASTAYLQISSLKAEDTAVYYCSNDYLYSLDYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6150 - protein, 1101 aa, Artificial Sequence
  Synthetic Polypeptide encoding a CAR with optional accessory module(s)
MALPVTALLLPLALLLHAARPDIVMTQSPDSLAVSLGERATINCKSSQSILYSSNQKNYLAWYQQKPGQSPKLLIYWASTRESGVPDRFSGSGSGTDFTLTISSLQAEDVAVYYCHQYISSYTFGQGTKLEIKGGGGSGGGGSGGGGSQVQLVQSGAEVKKPGASVKVSCKASGYTFASQWMHWMRQAPGQGLEWIGWINPGNVNTKYNEKFKGRATLTVDTSTNTAYMELSSLRSEDTAVYYCARSTWYRPLDYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6151 - protein, 1225 aa, Artificial Sequence
  Synthetic Polypeptide encoding a CAR with optional accessory module(s)
MVRGVPFRHLLLVLQLALLPAATQGKKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASGGGGSGGGGSGGGGSIYQELTQLKAAVERLCHPCPWEWTFFQGNCYFMSNSQRNWHDSITACKEVGAQLVVIKSAEEQNFLQLQSSRSNRFTWMGLSDLNQEGTWQWVDGSPLLPSFKQYWNRGEPNNVGEEDCAEFSGNGWNDDKCNLAKFWICKKSAASCSRDEEQFLSPAPATPNPPPATRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6152 - protein, 1101 aa, Artificial Sequence
  Synthetic Polypeptide encoding a CAR with optional accessory module(s)
MALPVTALLLPLALLLHAARPDHIVLTQSPSSLSASLGDRVTISCRASQDISTYLNWYQQKPDGTVKLLIFYTSRLHAGVPSRFSGSGSGTHHSLTISNLEQEDIATYFCQQGNSLPFTFGSGTKLEIKRGGGGSGGGGSGGGGSQVQLKESGPELEKPGASVKISCKASGYSFTAYSMNWVKQNNGMSLEWIGSIDPYYGDTKYAQKFKGKATLTVDKASSTAYLQLKSLTSEDSAVYYCARRMITTGDWYFDVWGAGTTVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6153 - protein, 1101 aa, Artificial Sequence; identical to SEQ ID NO: 6152
  Synthetic Polypeptide encoding a CAR with optional accessory module(s)

SEQ ID NO: 6154 - protein, 1048 aa, Artificial Sequence
  Synthetic Polypeptide encoding a CAR with optional accessory module(s)
MALPVTALLLPLALLLHAARPGMRTEDLPKAVVFLEPQWYRVLEKDSVTLKCQGAYSPEDNSTQWFHNESLISSQASSYFIDAATVDDSGEYRCQTNLSTLSDPVQLEVHIGWLLLQAPRWVFKEEDPIHLRCHSWKNTALHKVTYLQNGKGRKYFHHNSDFYIPKATLKDSGSYFCRGLVGSKNVSSETVNITITQGLAVSTISSFFPPGYQTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6155 - protein, 1048 aa, Artificial Sequence; identical to SEQ ID NO: 6154
  Synthetic Polypeptide encoding a CAR with optional accessory module(s)

SEQ ID NO: 6156 - protein, 1101 aa, Artificial Sequence
  Synthetic Polypeptide encoding a CAR with optional accessory module(s)
MALPVTALLLPLALLLHAARPDEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKGGGGSGGGGSGGGGSEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6157 - protein, 1103 aa, Artificial Sequence
  Synthetic Polypeptide encoding a CAR with optional accessory module(s)
MALPVTALLLPLALLLHAARPDIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKRGGGGSGGGGSGGGGSQVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKSRGSGATNFSLLKQAGDVEENPGPGIHMNRHLWKSQLCEMVQPSGGPAADQDVLGEESPLGKPAMLHLPSEQGAPETLQRCLEENQELRDAIRQSNQILRERCEELLHFQASQREEKEFLMCKFQEARKLVERLGLEKLDLKRQKEQALREVEHLKRCQQQMAEDKASVKAQVTSLLGELQESQSRLEAATKECQALEGRARAASEQARQLESEREALQQQHSVQVDQLRMQGQSVEAALRMERQAASEEKRKLAQLQVAYHQLFQEYDNHIKSSVVGSERKRGMQLEDLKQQLQQAEEALVAAQEVIDKLKEEAEQHKIVMETVPVLKAQADIYKADFQAERQAREKLAEKKELLQEQLEQLQREYSKLKASCQESARIEDMRKRHVEVSQAPLPPAPAYLSSPLALPSQRRSPPEEPPDFCCPKCQYQAPDMDTLQIHVMECIELETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA
